United States Patent 11,549,145 (METHODS AND COMPOSITIONS FOR INHIBITING AND TREATING NEUROLOGICAL CONDITIONS) - sequence listing, part 48

SEQ ID NO: 1039 - DNA, 494267 bp, Homo sapiens
ttggatttaacaaagctgatttctttcctgcaggaattccgaaagcctttgacatatattatatacaatgcgtctccaaaaaaagaaatacaaacagcggttcctaaacatatttggccatggggcccttttgaaattgagtaacctaccaataccttgctgtacagagtttgtgaaatgccaaactagaagtgactatcattgcacttcggatcctatgtcattgatctgttgattctctctggttcccaacagatccataaaaaggaaacggcattcctggtgggaggccagagagatcaaacagtggtggaacagaatgggtacaggagccctaacctgaccctttccttgggaagtccagggcctctttctcctttgtaaactagtctttattcctacaataacctgtgatctgcccttggctgtccaaataagaataatgctctgagtatgagtggcattacaagggcccccctgtttctgtcgtgttctgaaagaccccacttgtcatacagggtctggtttctttcttggcctcaggaccccactagtggccgagtgtgatgggggcctttgcctgcctggtctaagggcgggtcttgagcgtggatggaactagcgtgggcaggtggcgagttcccctggctgggatttttctctttttgtttgtttgcaaaacactgttaaaagattattgcctcctatattgctgaggtctgactacagtgtctgcgtttgatggaggtggggcaaggcctagagggggcctttgcccaaaggtgagccaaacactagtaagaatgtgaaaactagccactcgcagacatctcacttggttatctggcaggtaagcaggcacgtgggtaggcagagggtgtgatgcccatcgctcaggcctgttttgaggaacctggaggctctcaaaggcccacctcacagtcagacaatgctggaatgtcacggtgaaggaaaatgggaacaaatatagataatcggttcctgggtcaaaggcatttagaaagtatgttctcaggccctccattctgttcccatcaggaaccaaggctgagaaggaagatgaggcaggagggggacgagtgtagcagagcactcttcccctcccagcctggatggcgttagtcagagaacaggctggcaaaagacttcctcaggttgcggatggtttcagccttggcctcgtcttcacttggggtcccacgctgggaggtgtcggatgtgctgaggctgttagtcagggactgagatttgctgaaacagaaaggcaagggggttgaggaagacaaggcgaagactatcaaagaaatgggtcttgggggcttgcctgtaagccagatgggctaccccaatcatcataaggttatgaagaccagaaaccaggcattccaatgcttacatgatgtcaggtacattacacacataatttgcaaggtggttattttccccatttcttaggttcagaaataggggttcacagagtcaagtaacttgctccggtcctcacagcaagtaatgggggagcacccagaggccacattctttccattataccagactgttgaggcagcaggcattgctggagagtagcttggctgctctcctgcctatgggtacaaacccactttgtaaactgcaatgtgctgtatcaacatcaggttatagttatttccagcactcgtttaggtatcaggaggcctgtattctagaaccttctctgctctttgatgtgtgtagccttgggcaaggaacttaccttctcagggcttcctttgcctcatctgtagagcgaagggtttgtcctgctgaccctcaggcctcttccagctctgacattctggacttcaattcccatctcttctccaatgtctttatggctaattctgtcccccacccgcttttggaattcttttagtgccatctttttgaatggcagatgccattctgagtgcttcctaaatgccagcctgtagcaactgcttgctgagcacttcccctgtgctaggggacaggggtgtaagacgaatatgattcaggccctgcctcaggaggctcagtcataggaggggaggcaacagacctaggaagagattatgtaaatgtgtcaaaagttgaagagctctgcatgtgatgctgtcatcacattaaaaactgcaccacactgtgctgggcgcagtggctcacgcctgtaatcccagcactttgggaggccgaggcaggcggaccacaaggtcaggagatcgagaccatcctggctaacacggtgaaaccccgtctctactaaaaatacaaaaaattagccgggtgaggtggcgtgcgcctgtagtcccagctacgcgggaggctgaggcaggagaatggcatgaatccttgaggcggagcttgcagtgagccgagatggcgccactgcactctagcctgggcgacagtgagactccatctcaaaaaaaaaaacaaaacaaaaactggggacttcaacgcagggactgtcttttactccttgcttattacccctcagagagtcttatctagaacaaggcacagagtaggtaaattcagtaaatacctgctgacttgaattgaaccaagttctttaaagcagtaagtcaggaaatttatgtgtttttagctagaacactgtaaggtcagtgaccaaacctggtttaaggcccagagcccctgtctgtcctgtgattagttggctgatctccttatgtggtgacaggctgtatgcagataagcctctgtagtggcagcagcattctaagcaccaactgtgcataaactcattgcaatccttataataaccctgtgcggttattgtccccattccacatgtgaggaaattgaagcacagcgaggttaggcaacttatctgaggttgtgtagtttttaagtggtggagctaggatttgaacccaggcagtctgactctagagtctgtgctgtcaactgctattccatattgccaggagggccatttgctagtgtctgtcaaactaaaaatacatttatcctttgatctaacaatatcatgtcaggttattttctctagagtgagtcttgcaactatgaaagtatatgttcagatttattaattgcagcattatttgtaagatcaaaccaagtttctatttgtgatggattagttagataaattatagtacaatggtacagcggaatactatacagccataaaaaataaaattcgaagaaactcggtgctccaggatttttttttttttcgagatggagtcttgctctgtcacccaggctggagtgcagtggcacgatctcagctcactgcaagctccgcctcctgggttcacgccattctcctgcctcagcctccctagcagctgggactacaggcgcacgctgccgcgcctggctaattttttgtatttttaggagagatggggtttcactgtgttagccaggatggtctcgatctcctgaccttgtgatccgcccccctccacctcccaaagtgttgggattacaggcatgagccatcgcatccagcccaggatttattattaaacatgaaaagcagtgagcagaatggtgttgatagtgaatactcctgtgtgtgtgagaaaatgagggcgaggatctgaacaattttattatttatttatgcaaatattttttatttgcataaggaagcactgaaaggacacataggaactaacaaaagtcatttctggggatgggggtagcaaagcgttggatgagaatggggcgggaacgaggcttttcaacatacatctttgatttatttatttatttatttatttatttatttattgagatggagtctcactttgttgcccaggctggagtgcaatggcgccatctcagctcactgcaacctcagcctctcaggttcaagcgattctcctgcctcagcctcctgagtagctgggactacaggcgtgcaccagcacgcccagctaatttttgtatttttagtagagatggggtttcaccatgttggccaggctggtctcaaacccctgacctcaggtgggatccacccaccttggcctcccaaagtgttgggattacaggcatgagccaccacacctggcctgataccttttagatctttgaactatgtgaatatattacctattcaaaaaaatagttgttagcatgatccctggactggatgtcgtgggtctaatcccagctcttctagttattaactggaaactttggcaagttatttaatcttttctttgcttactcgtctgtacaatggggataagaaatagttattaactcctaagcttgtgagaacttaaaaaaaacccaagtaagtaaagtgcttggcacatagtaagtggacaatagctgttagctgtgaactgtgatgatcaacatttggccttgaaagaaggtagagctttccaaagatcagttacttgggacctctctttaggacaaaccaagagatgggcctgagaggaaacaggatgtatatgtgtattgtgatggatggcttacaaaaatgactgcaatgattcctcttgtccctgtagcctgcccttttgagatgtgacttcatggctcctcctaccaaaaatttatttcctacctcttgaatgtgggtttggccctgtgacttgctttgactaaaagcgtgtgataaaataacatttcataactcccaaggctgggcctcaagaggccttgcagcttgtactttctccctttttaaaagcagttctaccatgtaagaaagctcggcttagccttggggaggatgagaccccatggagagaaagaggcccagctgacagctagcaccaacaaccagatgtgtgtgtgaggccttcttggaccatccagcctcagtgaagctgccagatgactgcagtcgtatgagtgatcccaggaaagtagagttgccagatttagcgaataaaaatgtgtagataaatgtgcatttcagataaaaagctaagactttttttttagtgtaagtatattccatgcaatgtttggggcataattatactcacaattatctgttttttatctgaaatgtgaatctaactgggtatcctatgttttattctgtaactctataggagacaccagcagaagaacctcccagctgagctaaactcagaacaaacagctgaaccaaaaaattatgaacaaagagaatgattgttttcttcagccactaagttttggggttgtttgttatgcagcaaacaatagctggtaaatggctggtatgtgtatacacggagggtcacggtggtgtctaatctatactctcaccttgttgggcctccccagcaaattctgtcctctagtcctgtttttacctatttgaagtctaggcaaggcctcgttgggtcttcctttgtctccaagtccctaaccctgaatcagccaagctctgcctacaccccagctctatcctataccttttccaattcccaaagcacttacttgagatgcggatggggtggtgctggcttcttggactcttcaccctgctgggaggtactacggccctgcacagggggccggggctgtgaggcgagggtggcacctggcttggaggcctggtttggggagctgccactggatgcccgggatagctgcggagagcctggtgacctttgctgctgtggagatccggactgggggctcaggggctgctggccttgtggggagagcctctgttgggaggggcttccagatctctggggctgaggagactgagcttggcgagggcctcctaaggggccagaaaaaaaaaggttcagttcaattttttttcttaggatagatatggctgtacacaaataatgttgcttcaaggatgttcattacagtgtttcttataatggtgaaaaactgaaaaccgtataaatacctaaccataaggaagtaattaggaacattaagatacatctgtataatggaatatgctgtggtcatcacataggatgtggctgagtaatactaaatgacacaggatactgttgataacatatgctaaatattatactgctgaacaaaatagcttagaatacagtacttatggttttattttggcacatatgtaaaaacatatataaaaaagcaagactggaagactgtacactaaaaccagtgtgcctcagactttaatgtgcatatgaatcactggggatctggtcaaaataaagattctgatagagtgagtctcgggctgcgttacggactgaattgtgttcaccctgtcccaattcatatgttgaaaccttaaccctaaccctcaatgcaattctatttggagataggatctttaaagaggtaattaaagttaaatgaggtgatacggtggggccctaatctgataggcctggtgtccttataagaggagaaagaaatatcaggagtgtcatgtacccaggtacagaagaaaggacacacgaggatacacaaagaaggctgccatctgcaggccaaggagagaagctgtaccagaaaccaaccctgctagcaccttgatcttgtacctgcagcctccagaactgtgaaaaaaacatctgttgtttaaggcccccccagtctatggcattttgttatcaaggcagcctgagaaaactaatataggcaggatctgcgattctgcatttctaacgggttcccagcttatcctacgttgagtaatgagacactaaataatcattacaaaagtggtgagattaagaaggattttaattctctttttttttttctcacgggtattttccacactgaagatgtatttctttggaaacaacgacaagaattaactcttactttttgagttgctctctaaacttttccaagaactttcaaaagcaacatatcacttgacctagagaggtcagtagggaagataccattcttctcaccacatagaggtggagactgagtcttattaaggtttcccagttggaagaggagccacagaaagctcaaagagaatcttggtttctccctctcaccgtacagggcacacaggcttccacaagcaagccaagaggcatctaagcttggggatgttgtagccacccagaaatgactttgagtagaattccaaggcccccaacaatcaaggtgcactctcctaaccctcaaattctgggtgtcagggctgttgatggtgaattgcattttgccaaagccgactggctgcccgtaggtctcttctccctacgacatgctgctgctgggagagtggggttattcttgccacgtttttttgagagcaccgtaggcacgttaggagactgaaaactaaaaggtgctggaacccatctctgtgactctgtaacaatggggcttctactgagcacctattatgtcaccagctttggactgggcacaacagctctgtgggttaggcattattttcatcccctacccccagccatgggagtgctgtccctggaactctagagagagccacatgtataattacacattttctagtaggcacattttaaaaagtaaaaagaaataggtgaacataattttaatagtgtgtgtgtgcgtgtatataggtatgtatgtatatatataatttttaattaaagagatggggtctctgtcacccagggtagagtgcagtggcatggtcacaccgcagcagtgaacccctgggctgaagccaccctcctgcctcagtctctagagtagctgggactacaggcccaacaccactttttctttctgcctttttttttttgtagagatggggtgtcgctgtgttgcccaggctggtcttgaactcctggcctcaagcaattctcccaccttagcctcccaaagtgctgggattacaggtgtgagccactgtgcttggccccatttttacagagaaactgagacccagatatattgtgacttgcttaagatgtcactacgaataaggggacacgccgagattcaaacctagatctctttgactcaaaaaccctgttttattactttttcctttatgaaaactacaccacgcaggctcgcctgagtcctcataacatctttattgctaattaagaaaaggcggcttccttcagctgaagcagctctgagccagatgccaaaggggcaaggactagatttcagccagcctcccttaccagatgtcacgtcagctgagcacattttcagaggacatgccacctgtataacctccatgacctgtggagtctggtggccctgactccacactggcaccaggagcctcaggtcctgactcaagccttgccattaactcgctgtgtgaccgtgggtaagtcactccccttctctgggcttctgggccctcatttgtaaaataaggtcattggactgaacatcaaacatccctcccgatctgaacatttttgtgagcttgtggaacactaaattggattaaattgcagcatcagtttagcatctgattatattacatggctttgattcattacctctttcatgattgtataggcgagtagatgggaggtcacatttatctcaaacacctctagggccaaccaggtatgtaaataaataaagcaggcaaatataagaaaagtaatgaggctttcaaaaatttgcccacttgagataaaaacagtccagagaactatttctctgaagaggtgcaagcataaagaacatagcaattgcccctctctgtcactatggaagtgaggagtagggctggaggcaaacgcaggagcccctaggagcccttgctctgatcaaggaagccgctgttagtaacgccagggacagttgctgtatagaaacacaggcccattgtttctagagcttctgtgctatcaagagatgctggaaatctagatgtttaagcaacacctcttgattttttttttttttttttttgagacggagtcttgcactattatccgggctagagtgcagtggcgcgatctcggctcactgcaacctcctctgtctcctgggttaagagattctcctgcctcagcctctcaaatagctgggattacaggcgtccgccaccacgcccagctaattttttgtatttttagtagagacagggtttccccatattggccaggctggtctcgaactcctgaccttgtgattcgcccacctcagcctcccaaagtgctgggattacaggtgtgagtcaccgcgcccagctcacctcctgatttttaaatgttggttacttttgggttttctaaacccaccgcagttcaaataaaacatttgttttctacttttatcttcagtttcccctgattcgcctcccttcccaggttgatatcttagaaaatgtgaatacccattcattaattcagtaactctttgttgagtccctatcatatacctgggatttatcaagagagacaccctagttactggattcagagaccagagtgctaaccattaccactgccctagttatttctttcggcttcttggcaaagcaaacaatttagtatttttcatatgagcacatacacaaaatattaacatatatagaaagtatttgcctaagcacagacatgaagcttattaaaagaaaatttcacttttactgagttgaaatgaacagcaagttcaaaataataatgtgatttgttaattggggaactcaatgaaagcgttgtttttcattagccttgttatttttaatctgagcgttaattcactgggcattttctttaattaccttaattggttttaaattgattgtttttcaactcactaaaagtgtgtttagcctcatttcccttaaaataatatctctttatcaagcatgttttactctgggccagagaggaaatcagaatacagtagctctctgttttaaaacggctctgttcaaatgtgcttttaaaaagcaggtcccagggcagaggggaaaggagggtgtggggcagaggcacagccaggagcctggtagagtgaggaatatgtagtttcggaacacttattactatagaattcttgctgggtaacggggcactgcattagttacaaggattgttaataataaacatgaaaagcaatatgtataagacacacgttattaatagtaagcattatgtcatagttattcgtagtaaattattagtagtaagaactgacaccttctacgcactatctctgtgtctgatgccttgctaattgcttcacctgcatttatctcatggacaagcaccccatccttaaacatggaagctgttatttcctcctttacactgaggaaactgaggccccgagaagtaatatgacttgcctaacactgcaaaggcagtgagatacggaactggattcaaacacactagatctgcctgaaggagaatactaatgtgtattttatacaggcataccttgttttattgtggtccattttatttcagtttgcagatactgtgttttttctaaattggagggttgtgacgaccttgcattgagcaagtctgtcaatgctgtccttccaacagcatgtactcatgtggtgtctgtgcctcacatttgacaattgtcacaaatttcaaacttttaaattattattatatctgttatggtgatccgtaatcagtgatctttgatactactattgtattaataattgtttttgggtgccatgaaccacacccatataagacagtgaactggccgggcgtggtggctcatgcctgtaatcccagcactttgggaggccaaggcaggcggatcacaaggtcagcagatcgagaccatcatggccaacatggtgacgtcccttctctactgaaaatacaaaaaaattagctgggtgtggtggcatgcacctgcagtcccagctacccgggaggctgaggcaggagaatcgcttgagcccaggaggcagaggttgcagtgagctgagattgtgcaactgtactccagcctgggcaaaagagctagactccatctcaaaaaacaaacaaacaaacaaacaaaaaaagacagtgaacttacttgataaatgtgtgtgttctggctgccccatttaccagccatttccctatctctcttcctgtccttgggcctccctttcccctagacacaacaatattgaaattggaccagttaagaacccaataatggcctctaaatattcaagtgaaagggaaagtcacacatctcttacttttaaataaaaaaactagaaatgattaagcttagtgaggagggcatgttgaaagccaagacaagctgaaaattaggcctcttgcaccagaaagttagctaagttgtgaatgtgaaggaaaagttcttgaaagaaattaaatgtgccactccagtgaacacacaaatgataagaaatcaaaacagcctcattgctgatacggaaaaatttgagtggtctggaaagaagatcaaaccagacgcaacattgccttaagccaaagcctaatccagagcaaggccctaactactttcaatcctatgaaggctgagagaggtgagaaagctaaagaagaaaagttggaagctagcagaggttggtgggtgaagtctcaggaaagaagccatctccataacaaaaactgcaaggtgaagctgcaagtgctgacgaagaagctgcagcaagttatccagaagaactagcttagattattgatgaaagtggctgtgctaaacaacagattttcagtgtagatggaacagccttctattggaagaagatactatctagggctttcatagctaaagaggagaagtcaatgcctggcttcaaagcttcaaaggataggctgactctcttgttggggctagtgcagccggtgacttagagttgaagccagtgctcattaaccattctggaaatcctagggcccttaagaatgatgctaaatctactctgcctgtgctgtgtaaatggaaaaacaaagcctggataacagcatagtatttccaatatggttcattgaatattttaagcctactgttgagacctagtgttcagaaaaaagattcttttcaaaatattactgctcattgacaatgcatctatccacacaatagttctgatggagatgtacaagataattttgttttcatgccttttaatacatatcacgtcttttagttcatggatcaaggagtaatttaaaatctgaggtcatattattttaaaaatacattttggccaggtgcagtggctcatgcctgtaatcccagcactttgggaggccgaggcgggtggctcacaaggtaaggagttcaagaccagcctggacaacatggtgaaactccatctctactaaaaatacaaaaattagctgggcatggtggcgcgtgcctgtaatcccagctacttgagaggctgaggcaggagaactgcttgaaccaggacccgcgaggtggagcttgcggtcagccgagattgcaccactgaactccagcttgggctatagagcgagactctgtctcaaaaaaaaaatttttttcataaagctatagttgccatagacagtgattcctctgatggatcttggcaaaggaaattgaaaaccttctggaaatgatttacctttctagatgccattaataatatttgggattcataggaggagatcaaaatagcaacattaacaggagtttggaagttgattcccatccttatggatgactgtgaggggttcaaaacttcagtggaggaagtaagtgaagatgtcgtggaaatagcaagagaactaaaataagaagtgaagcctgaagatgtgatggaattactgcagcctcgtgataaaacttgaattgatgaggagctgcttcttatggataagctaataaagtgacttcttgagatgtaatctactcctgataaagatgctatgaaggggccgggcgcagtggctcatgcctgtaatcccagcactttgggaggctgaggcgggcggatcacgaggtcgggagatcgagaccagcctggcaaacacggtgaaaccccgtctctactaaaaaatatacaaaaaattagccgggagtgttggtgggcacctgtagtcccagctactcgggaggctgaggcaggagaatggcatgaacccgggaaagcggagtttgcagtgagcggagatcacgccatagcactccagcctgggcgacaaggagactccgtctcaaaaaaaaaaaaaaaaatgctatgaagattgatgaaaagacaacaaaaggatttagaatattacgtaaacttagttgataaagcagcagcaggttttgcgaggactgacttcaagtttgaaagaagttctactatgggtaaaatgctatcacacagcatcacgtactgcagagaaatcttgtgtgaaagggtgagtcaatgcatgcagctaacttcactgttgccttatttttataaattgcctcagtcaccccttgcttcaacaaccagtaccctgatcagtaagcagccatcagtattgaggcaagaccctccatcagcagaaaggttactattcacctagggctcagacgattgttagtaataaagtattttatcattaaggtatgtactttgtttttttcagacataatgctattgtacttaagagactacagtgtagtgtaaacatagcttttatatgcaccaaaaaatttgtgtgactccctttattctgatatttactatatactggggtggtcttgaaccgaaccagcaatatctctgaggtatgtctgtacacagttgtgtacaattatacaatttcccttttcttaaaaatatctcctgcttttccagaaggagaaacacaaacaagaaaaatgaatgggacattttatctaagacctgtggaagaggaagccatttggtggccaaggttgactttttttcacaaagtaatgaatctgttgcttttaataatagtgactgggaaggccacaacatgatagtaatgccttctttctgatatatatatataatttatttattttattttgtttttttgagatggaatctccctctatcgcccagggtggagtgcagtggcgcaatctcggctcactgcaacctccgcctcctgggttcaagcgattctcctgcctcagcctcccgagtagctgggattacaggtgcacaccaccaccacatctggctagtttttttgtatttttagtactgatggggtttcaccatattggctaggctggtctcgaactcctgacctcgtgatccgcccgcctcggcctcccaaagtgctgggattacaggcctgagctaccgcgcccggcctctgataggtttttaagaagatccttaaaagattgcagcgagactgcctgctttggtttcttggtgcacaggtgctctgaagctccatgctggtgccagagcgagtgtgcccaggaggttttgattgcaagagaggatacggggcggatttctctcaagactgcatgcaagaatatcagagcagctgatattctttgagaaagttagttagccattgccctgattgcttttcatctttttacaatagtttgtccattctctaataagtggtggaatgtagtaatgctggaatatatttgaggaggaatttcaatggccaaggttttatagatgatcttccctttttctatctttcttactctagctggtcgactcacaaatctatcatcaggcaccactcattgaaatgaataaacacttcctaggtttgaaaggtctgaaaggccagacttgtaaatctaccattttctgcctccttgggcaaagcctcaacttttacctcgcagtagaaaggctcacgcctgtaatcccagcactttgggaggctgaggtgggcggatcacctgaggtcaggaatttgagaccagcctggccaacatggtgaaaccccatctctactaatactacaaaaattagctgggcgtggcggtgtgcacctgtaatcccagctactcaggaggctgaggcaggagaatcacttgaacctgggaggtggaggatgcagtgagccgagatcgcaccactgcactccagcctggcgacagagcaagactctgtctcaaaagaaaaaaaaaaaaaaggaaataatgacattttcactgcaggacggctgggaaaataaaagtgagaaaataggtgggacattccctggcacagtgcttggtgcatattaggttcttaataaattaaccttctatttcccttctcctttcttgactttttaaagagtttgaccaaccccatagtctcattcattctgtggataaagtattcaggtgcattttcccagagccccttgtgggaatcacatgtggatccctcggtgcatttcagcaccctcactgcatgctttcttgcagtggctcgtcctgggtcataccttgcggaggtgggcgtggctggggctggcctagctgaggccccagctgggcttgccctggggatttcgctgatttaatctgtggagcctagagcagaagagaaaagaagcctgttggtatcaccacagccctttacttcctgggtgagagggcagcatttatgaagatctttttatcattgagaagagactcttacacataaagtgtacagttctggagtatacagtgtagtgaagttctatatgtgtatacgtcggtgtaaccactgcccagatcaaaacagagggcattctctgcgataaagcctgccccgtgccccttcccagccagcagccccgtcagtataataactacgattctgatgtttgttatcatagattactttctgtggggaaatctggggtgggaggtggaagtttggggacttgcttttacataaagctggggagctggcaaattctttggagagcagtctggtaatccatggtgggaactgtggaggggaggagcgacgtgggagctcatcgaggttggggaaaatgggagacacaatagcgtccattgactggttccctgggagcacacagagggcttgtgtgtccatatgctctcgcacacgcacgcacacacatcctgctcaggcccagcaccgagggcacagaagggacagcagtcgatcatctctgcccacagtgcccaaaggccatttgagacaagattgttctccccaggatggtgaagaagggaaggggcctctgaaagcctcctcaattcacttactggggcaggctgtgaaagctctccccaatgtctggccttcgtccacacccccattccttctccccaaggtggtttcttcctgggggtatcccctttggatccaggggctccccatttccagacagcctggcatttctcatggctataaagtctcctttgatcgtgagggtcttacccaaggtctgaggggggagggcgctgtgcctcctggcatcgggagctggctcattttggagacaacaaggtcggccatcagctgtctgtcctcttccacatgctctccaatcagcggcattgagctgtccattacctgtggggaggaagggagagctgagggacccccatgccaggagagatggcggttgggcatcacatcccagaagtgggggctcagggctcaggacagaagtgaccaccagatggcgatgtcctccatgcaaatcacctccagctgggactggccggcagcgacatcagttcccttcggttcagtctaaaccactccctggaggtagttcaattcggcccacgtttgctggatgacagcaatgcgacaagggccagggagcctctgccgaccttttctgtgcttttctttggggagccgctctccgccccctcctttctcaccctggccccctcccagggtcggggctggccacctctcctttggccccaggtcaaggctgctttccacaaagcagaaacagtaaaggtgggggcttgatcatgacaaaaatatgacgcgggctggagttgacccagggttcagaggaaagagggaagaggaaaggcctgttttccgaggccctggcaaaacacaggcgggagggaaaagcattccacagggagctgggctgttctcaaagtgcttctatcgggaggaacctgagggatccgagtttccccttctgctgtttttacaaatagagcaactgaggcccagagatgggaggggacttgcccaaggtcacacaggccaatgctccacgtgattccctgggcatgggaagctatgggagatctggaaggggtgtctgtcaggccttggcgcatctgcggaacagctggccgcgtcaccctctctgctccactgcaggagtcggcggcctgcattcacccacgccaccccatcagactcaccgtcttgtctcccctgttcccacgctctggacatattaggttttctctctcctccaggttcttatgtaatccctctacccactccttacctggccaactcctttcatccaacagggaacagctaactaggtcttcctccaggaagccctctctgatagtgcaagctctgacgagccacctgacaactgtatcctgccgttctcacctggtttcacacgggacagcttatccacggcactgtcaccccttgcttactatgtctccaccaccagactgggagcccccaaggttaggaatgggccccgtgtcctgctaagcaggtgtgccctccacagacacctgtttagtggaggaataagacgcccttgtgataagcccggctcataaggataaggatactaagaagcgccgtattttatggggcatttcctacgtgctacgctctattctaagcattgggtgtggaggatctctcataaacctcagaatagctctttgaggcagtactattatcctcattgtaatcaagaggaagcagagggtcaaagaagtggcaaggtcaaggacacagcactggcaacccacggtcctcccactgcatcaggctaattcccaccaagcactggaacagcacaccagggtaggaactgagaagagggaacctgggttccaggcttggcttctgctgtgtatttgctctgtgatcttgggcaagtttcttttcctctacgggcctatttttttttttttttttctcaacagtgaactgagggatctgggcagctgctaagacccttccagctgggacttgtagggatctgtgagtttaagcacccactttgattaggaaactgaaaagctagcttaagaatgtgaatactggctgggcgcggtggctcacgcctgtaatcccagcactttgggaggccggggcgggcggatcacgaggtcaggagattgagaccatcctggccaacacggtgaaaccccgtctctactaaaaatacaaaaaaaattagccgggcgtggtggcaggtgcctgtaatcccagctactcgggaggctgaggcaggagaatcgcttgaacctgggagtgtcggaggttgcagtgagccaagttgctctatttgtaagaagagcagaaggggaaactaggatccctcaggctcctccccatagaagcactttgagaatagcccagctccctgtggaacgcgtttccctcccgcctgggttttgccagggccccggaaaacaggcctttcctcttccctctttcccctggcgacagaatgagaccccgtctcaaaaaaaaaaaaaaaaaaaaaaaaaaaaaagaatgtgagtactgcttctagcagggtcctgagctctgcgcaggtcgtacctgggactgaggcctcctggatcccagcgccccagacagggacagtctctcagtcaccactggctgagctctgactgtggagtctgccgcgaaggtacacaggcttgctgcaccctgcctgtcctctctccccctgcccctgccaaccccattttattctggtctctgtttcctacattccctgcagtggaaaacagccaccgcaaggaacctgaggttcattttggaatccccacggtagagacagccaaaggaagtggccaccctcgtctccccagggaaacatttttccagtgagcaatgtcattccccggacaaggtcagagaggacaagttcaagggtcttttcccctgagtatttcactgtgagcctcttcacaaaacatttcacacacattttcagttctcaccacagagatggctgaagaaaccagtgttttgggatctcttctgcctttttttttttcccttactgggggaaaataccttttatatttctggtaacaagcttcccatctcccctgaccccactccaaactcaaaagcaaaggaaacaactctgcaatgtttctgcgaggaaaaaaaaaatctgaaaagctatctttcatttttcccctggaacattcttgggagacgttgttttcttattttttgaagtccgagcccactacttttacttttttttttttttttttaatgtgaaaggtctttcatccccaaccctctgaatggctaaaggcaggaagcctgagcccatgaacacagatttttttttttttccctaagactgaaagctgagacccggagaggtaggggctcacaggggacagagagactgctggtgcaagggaggagctggcctttgggggtcagggcagtccgggagctctaggagacagggcccctgctcttgtgtttgcagttgtactgtgtccacctggcttgggggctggctcctggagcagcggctcagtgaataaacaaatgagtgcgtgtgtgccaaatctgggttcatgtctggtggtccccgtgaggggatgcagaggcaggaggacctggtggggtctcaggagctgccgtgctgggggttcctgccccacctctgggctgaagctcccagaaggcgagggaccggctcctccagggagcaactgtacaggtcaaggagtctgttcccagccccttccatggctcctccaagtaggggctacttggggaacttcaggtgtggtggcggccagagggaaggcgtttccgggccttgagaggagagctgttctccagagtgggactaggtctgctaatgcagatgcagctcttcctgcaggagcttcctggcctctctggggaggagagaggggctgtgttcatcctggactccctcctcctacctccaaggcctgggtgtgaacaccctcctggcatgactgggctcccacccactgagtcacctggtcctgcttggccgtgggcccctggggagcgaggcagacatgagagacgggaggaccggctggctcctgtggtcaccccagccatgtgcttcccattagccgcccacaccccggggaggggacggccgcagggctctccctcacgtgtcctggccttgtgtcagcaccgcccatggaaggagggggctggacgcggcactggagctgtgagtgtggagatgggaagttatggcggactctgaggccagaggggcttttcaggggaaagcagtggagagccatgggacatggagtgggggggcagggaagaagagttggggaggggacgggagggctgtgggaccgtgagagacactgggaagacatggaggagaggtgggggttagtgggatacggggaaacagagagaggaagcggcggggatgggaggactataggattgggagaggcatgggctgctggagggtcttgagagagattccgggacccacagcccctctgtgagccctctgttaccattctgtttccctacatctttccctctattcatgcccctgtaccattccatcccccttccaaatcctcaatgctctgccactgtttctcaccctctcccctgccagcctgcacaccccatgtctattatgtccacggctgtatccccagagccacacccatgcttagcccatgggagccccctaaggccatgtttgttgaatgaacaaatgatggactgtctgcatggtgaccaaggaaggtgcccatttcacatgcttggacactggggaaatggaaggggccccatgggacagtatcttgttgacccttgaccagatgccctttccttcccttaggcctgtgggttggggatgttgttcaacctcgggccctgaggtctcccgactcagttccaagtccccaggcatgaagcctttcgatgcctctgagggtgggaaggagcctccagaagcaactcactgaggcctgggttgcgtgtgccctggagccaggacacagctgatggtgccaaagaccatgcagggattccctccccctggcacgcctgccaggctggaccagccaggaggactccctgcttcatccctcacctcgatgatgtaatctctgccatccttgctgtggacagccttgacggcacagatgtccaggccgccaaacatttccgagcagctgtccacccacagcctgtacctgcagggacagatggacagacagtgaagtggcctgggaaagtggggaagcgggtagagggagagaagtggattcacatggaaaaacaggcagggagggacagtgactcacacatccagacggcgatggagagagacagagaagcagcaagagagacagaaagacggagagagagttggagtccaacacgcagagacagagaggcagggagagaggcagggacacacatgacagtgagagagagacccagagaaagaacacgagagagccaggaaggaggggagagaggcagggagagaaggaaccagagttgggagaggtctcccccgaccccaggacttgctggctctgcagtaatggggagcttgccctgtccccatccggagtcatcctggacacccagccacccctgtgtcccttttcccttgggaaagctgctccaagggctccagaagtccctccaggctgcccttccagtcccagccctggccggacaagaggctgtggaggacaaagggtgcatttttcccagggcccggggcgggtgggctggggagactggcaggctgcttctgcctcgcccagggggcctggccctctagacccactgcttttgttccctttccagccacttgatgtctgcaaggccagtttgctttgctggggacagatctcagcactggactctgaccctgcaacaagggggtggttgtatgtgaagaaactgttccagctttgcacttagcttcccctgtgggctggatttgggagtcacaggggactctgtgtcaatgttcttgcttctcactctccagggtcacacggggcacgcctactctcacatcgctttgcgtctctgagccacaagtgctgggatgaggagggactgtgactggaatgctcttagaatggagtctcatctcatccaccaaagcctactgaggcccagagagggagggtggctggtccagatcacacagtaaggtgtaagaacaccaggattccctcgatctccttgactcccagtccagttttctcattcagctgtagcacggagcatgtgagatcatcaaataaaaagaaggatggagactcacacccatggagctcctggtatgttccaggcattctgggcccgggggctgactcctcattccctcgaatcccagcacaactctatgaggaaggttttaacccatcttactgatggaggaacaggctcagagcgatgattaagtgactgtaccgcttccaaatccagatcctgtctgattccagcttccaagcaagccacccttcctctcattctgaaggtgccccagcccatccattctcactcagcatgggagaccagggacctacattcttgctattaattccttaataattttggaaaagcctctccctcttatcataaaatgggaaagcctagatctgattctggttgtacatcagaatcaccaggagagttaaacgcacaaacagccagacttggggctccaccctatgttagagtaatttctataattttttaaagcttttcatgtgattctgatacgtggccacgtttggggacaaccttgggtccttggagctcgaagaatcctctgggctctctgatcagggtcctcgtttttggccccagtggctgacttgtgggtgccacacacagggtgagctctgccctgagacacactcataaatcaggtttcttctcaatggaacgtggaaatttgagctgaggtccagaggcagctgtttccagaggctgttttgaaaggatgaaccttggggtcccctgctggctacgccccatagggcacaggcatcccagggtctaggaaggggctgcaggcgtacagcagcgtgagagtgcttggagaatcggggggggggccctgctcccctcctgccaggtgggactagcactgaccaagcgacatcattggttttgcccaggagtcaggccacctggcaagcaggcgagccagtggagggcggggtcaggccctgtgtatgagtccctgtatggattttgctcctgtggggataggactggggatctctccagcccagaccctggagttctgcctgtgattggaaaagggaaagtggattccaggcctgggcaggcccactcccacgttaggttcctccagggatggcccatgcagcctgggacttggcagagccagggataggtggcctgctggggacatctgtgagtggctcaggaggcactggggaaggctgggctcacattccggaagggccatagagaagatggccacgactgtcccgtgaacacctgttgggggaaggaggtgactgcctcagccacatgattcagtcgtgccaggtcatgagcgcagcctccaagagactcattagcacaggtgggttcccaggttgaaggtggcagctgccccctggggttgatgggaaggacaggtgttcctccctgccaggggctggttctggattaggtgcagccctctctcattcagtcctcacacctgcactctgacttgggtattactactgctttcgttttgcagttgaagaagctcagaaagcatgagcatgcctaaggtcacactcagtctttgttgctgtaggggatgctcccactccagtctccaggggtgcagacctgacataggcctccaatcacagcgttgcagtgtcttgggccatagtgattggttcagggatggtcatgtgacctaagccaggccaaccagtacatatggctcagttctaggctttggttgaaatgactgggaaacagaagttttccttcttttgaacctgacactgtgaggatgaaagcctggagccactgtgtgccaccatgaaatgaaagagcctgcctggatgaagccaacacacaaagaagctgaacttgggtgggcagaggaggagccttaaggccttacctgacactgtatatctggagtcgtcagtgacatgagccagtaaatccccctttctgcgcaaaccaatttggtttgtgtggtagcccttgcaaccgatacagagttcttagagggaaggattggattttttcatcctttagcgctcagcacaacatggcctgcagtaggtactcaataggtgtttactgaacagagctttttgagttcacagcccatgctctgtccattgctattgtgtggctgctagcagaggtcacagggcatgcaggcaagaaggtatgtatgtggcaggccctgagaccagctgacttggcccttcgacccttcccccccttttttttttaaacagagttttgctctttttgcccaggctggagttcaatggcacgatctcagctcaccgcaacctccgcctcctgggttcaagtgattctcctgcctcagcctcccgagtagctgggattacaggcacccaccaccatgcttggctaattttgtatctgtagtagagatggggtttcaccatgttggccaggctggtcttgaactcctggcctcaggtgatctgcccgcctcggcctcccaaaatgctgggattacaggtgtgagccaccgcacccggccggcacttccttaagtggggctggcacacagtgtctaaagggagaaagaccgaaaaacccttcagccagagagcatccctaaaacatgcatgattcatgggacgtcaacctttccctattcatattgagatggaaggacgcttgagagagaagtggactctccaatatgcctggtctcctaataatgcttccttgcagctgtcagagcacaggagggactggccagggcttcctgacctcttcctatagcagctggtcagggctggaaagacctcggacttggagtcatgacatcagggttctactctcagctctgtcatcaactagctctgtgatcctagacaaatcacttcccctctctgagttttcttctcccatctgtaaaatggggttattttaatacctgccctgtaggttgctgtgggcagtgaagatgatcatgtctaaaaaagtgctctgtggatggtgaggcactggacggagggcggagtggccttctcttcagggccttttgttgcattcccccttcagctcctactatggccagtgcctctccctacacctcctttgtctcttacctctctgtcatggccacctgctccagcatggcagagcctgtgttggccttccagttcccagagatggaggttctcctgtaccagaacaaacaacacattgagggaattagggaccctcgtcactgatctgctttccttctttgctttggctgttaggaggctctgattcaaataactggctcacgtaatggcatgtattcttacgtacacaccttgtcttcaactatattttcctatgtttatttcccttcatgctgtttgccttttttatttgttggatcctaggtattgttttctaagtcatctttgaaattgaaagattaaattaaaaaatgcctacatcatctgatgaaatcccccaaactttggcctgtttttgaggagaatgagggcagtgtgtatagcccctggtgattctggaatcttttgagggccccaaaatgttagaaaagtgatccttagagagaagtgactacttttctctggtgaagattaggaaggccttctggtctctgactgtcttgccatccttctctgtttccttgccctttctgctccagtaacaaccgacctcccttccggtgctccactgcccatggctctttcccaatgtcatggcctctgcaggtcttcttccctttactccgtacagtctttgtctccatctttgcctccctaagtcctgctcatccttcaggtttcatctgacatacgacttcctgacagcccacctttacacagcaaaaatagactgcccggtactacgccctacactaatgctcagtaatgctcatctcccttctgatgactgcattagtgtcctctcttctctgatggaggagaatcctgacggtaggggacatgtttaacttcatcccctgtatacccagtatccagtgggatccggcaggtagtaggtgcccagtaggcacctactgggtgaggaactgtgtacactgggggagaatccagacaagctatctatcactaatgatgcatctggcctcggcaaagactgaacgagtttaagcatagtggtggaggtaaagctatttgtcttacggtcaagggaagctatgtcattgagatcaaagggtgaactggtgagaggaattgacacaaaaatgtatcattgtaagagaaaattgaagtaaaaatgctgagaatagatgaccaccaggagccataaggcactgcaccgtagttggcaaggttgtttcccatggagctacaggtgaaccattctgagactgggcacatacactgagatggaaccaaaaaagtggaatagatggtggatgggggagctggatttttctctgttggagtgggaagttatagattagcaatcaggaaaggctaaaatgaacgaagtggtaccagatgaaagtcagggacatccataggactctgtttagcttcatagggatgtggatgggaacatatagaaaaaattatggatatatgtgtatacacgggtaaggatacacacatgtacttccttactgtgtctgctaggacttagaaagaatgacagcccagtagcgacaagcacaaaggcccgagtgcagggcaaggagtgggccagagagggggttgaatggccggggaaattctacactgaagtctgacatgaaccccctcctttggagatgggccagcccaaggtccaggaaactcggtaagtaatgacaaagtggagctgtcaggccagggaggctcagcagaaaaatgctgcaatgaggtaatcctcaagaaaaaaaaaaactgggacaaggtgtcgtcaatgtcaagtggaagctcaaacaatgaagagaggagggaaatgatatcatggctgaaggcaggggcctcaggaacgcactggaatgggccataactcagagggggcagggaggaggtgattttatcaccccgaggccatctgagagcagtggcaggtctggcttgcctcacaggaggaagaggttgattagtggaatagggcagttactcctcaagaatgagctccatccctttcctgggaacacttccttctagggcaactgcctgcacctcctccagtttcacaagcaatgacagggctcagtagttgcaacagagacgatatagcccgtcaagcctaaaattaccacctggccctctacagaaaaagtttgctgacccttggtctaggcaatccaggtagtgctaaagcaaccacaggcaatccataaatgggcgtgcatggctgtgatcaacagaactgtatttagagacaggtggcagctggattcggcctgtggttgtggtttgccaaccctagcttaaagcacaagctacccacacagaagcctgcggatggagggactttccagctgtccagggctaacccttgcagtcctcagatatggagccctgcacacagtcagtgccccataaatgcttggcaaccaggcaacgattggccctctggggtctcatcatttcaagtggaactaacaataacattccagagtgaaagatagagagggcttggagcaaagacctctcccaagaacgagacagtctgcctattccagaagtccccattcatccttataaccacagccccatgtaatccgtgctttgttgaaccacctctagggtgaaggcgggctgcttttctctgcctggcattctttccttttcctctagattcagcacctctatttccactgggcaatggctctgcccacactgcatgccttcttataaagttttctgcttttctctaatcaataaaatgcgatcaaagttggactaatcagtactttttccacggaatcacaatcttgagttaagccttgaaaatgactagggcagattcatttaccagtagggatgccatgaaaattgtttattattatttctggctgcccaccttcctggggctactctgtatctgaatgtttctgaaattgataattgagttgggagatatttttgtttgcttttttaaagtttctgataacccatggttttctagtaaattccctttaaaaacccattaagttaatgagatgtggtttctgttgcttgcaggcagagaaatctggtgtaacctcctaactggtcttattggcttcagagaaaccgttctgcacctcccagcctcatggtcacctttttataaacacagatcagaccctttgctcagaagagaagagaaaaatactccaaaaccctcagcaaggtattcaaagccctccttgatttgtccccaaatttctctctcaaagacatatatcctgtgtgtatgtgcagttccctagacatgccaagcacctttcttgctctggaggaaacagcccttgcttgggtagacagatctctgcccagggataagcagtgactggacatcagcccctcagccacactggacagagaagaagggcagtaaggagacaggaaggaggataatgatgcacccttgggtgcaggagacagcggctggacatgcacctctgggctgccttcctcccacactcccccagcccctgccccagagactcacatgtaagccttgtagttggatccaattttctggatgcggatgtcgtacttggagtcgatgaaggcctcggtggtggcgtaggttttggccatggcgaccacgctggtgatgtcctggaagtcaagctggttttccactttgatctgtgtgggaggatgagggggatgagtgccacccaccccgtgttcactgagcccaccctatgccaggaacaagtgctctgtctatagacacgaattcccttcagaaggtcacctgctggcaggggagacagacacgggaagcaaatcattccaccacacaccgcacgagctgcagagaggaagggagtgattctgcttgggtggtcaagaaagctttacagaggaggtgagctctgaactgggtttggaaggatgaacatgtttcagatggatgaggtaggtagtggggccatcctccagagatgcacgaggaacccacagtgggggaaagggcaggtggcacagactcgctgatgggggatgcggcacgggccatgggggaacagactgtggagggccacagtctctgggaaggagctaggatttttagcctgaattttctggaaagccactggaagagggagtggagtttaaataaggaaatggtgtagtttgcgttttagcaaaatcactgaagcagctgtgtagaggatggaatggatgggtgtgatatgagacacagaggggccattaggaagaagggagcgtgcatgtgtgcatggtgtgtatgtgtagggagcatgcatgctggtgagtgttgtggagtttgtgggagatgtctgtgtgtggtgtgtttgcatatttgctgtatgctatgtgtggtatgttctttgtgtattcatatgtgtgtgtgtatagtgtgtgatatatgtgtgtgtggtgagtttgctgtgtgtgctgtgagttgtacatgtggtgtgtagtatgcggtgcttctgtgtgtgtgtgtagtgtgtgatatgtgtgtggtgtgtttgctgtgtgtggtgtgtgttgtacatgtggtatatagtatgcagtgcttctgtttgtgtgtatgtgtgtgtgtgtgtgtgtgtgtgcgcgcgcacacaggcacacactggagaggccagctttgctaggccagaggctgggagagaaactcacactgttgactagactgagccaggaacacagagaggtgtcctgggcttggggagaggtcccaggagagcttccaaggccaagcgcagaggacgaggccaaggctctatgatagtgatcttaagacagaacagaggctgactcccagcggctgtggacagctgggccagctgctccctcccactggccacgggagccctgcttgtccagaagcggctccccacttccctgtcaccctcaccccgacagcagaggagttctgatgctgggtcagagacgggcagagccctgtggagtggccgggcactaggcggtccacgtggggttggtctcggccacaccccatctcacgtccttccgatcttcctctcagcccttttctgcctgccctttgtggctcagctttgccttggcaactctgtccctcccacaagaatgcccactcacatttccaccagcgttgatgcttatgcagagtctttacagctctccgtggggcccaaacaggattgtgagcaggcaggcaggctgggcactgtcgtggtcacttaacagataaggaaactgagatttcttgacttgctcaaggttataaagcagctgagcccagagctaggcttgaaactctggactccgaaggcacagcttttccttgaaccatctcaggggtctgtaagtaggtgcctgcctgttctaccacaacggacctaaacagcaacaggagagaggctggaaaagccatctctcttcttggctctctgagtgatgactccaggtctcaatttgcagagaaaataaaggtgaccaggcaagagttccctattttccagcccttttcaaactcagctaccccacttcttcctcccagctgcagtggcggtggtgtgcctccttcctttgttctgggccttctaagcccttggttttagctgggtacctggcctcctcagccagagattactttgctccagtctgtcgtgcgggtagatgtgcctgagtctccaagctctggccggtgaaacctgggtagccgtgatattagcaacctctgggtggtgccctgaagatgaaaataatcttccccgtcctttttccttctttgctctggcagggaatgtgaacatgatggtatgagcagcagcctccatcttgggccatgagatggaagctgcatgttgaggatggctgagtagaaagatggaaggacctgggtcactagcactgtgaagctccctttctgagacagggtctcaatatgttactcaagctgagtgctgtggcatgatcatggctcactgcagccttgacttcctgagctcaagcaattctcctgcctcagccggccgagtagccgggactacaggcgtgcaccaccatgcccggctagtttttgattatttgtagagacagggcctcactatgttgaccaggctggtctcaaactccttggttcaagcgatctttccgcctcggccttccaaagtgctgggattacacactcgagccactgcgcctggcccctattatgtgggtctttgttaaagcagccaaatgacatttctgctcattatttttactctcttgcttttcattgattctttattctttggattaacgtgatcaaggatccaccattctcctcaacatgttcctgcttttcagaacctcagttacgcaccactgtctatctctacatcttcattccccacttgcccctcaacccactttctttaggttttactccctaccattctcctgagactgatttggccaaggtcccttttagtccactctttggcaaatcccatagaatgcctctggtccttgccctgcgttgaccctctgtagcacctgaaattagtgaactttgggaaatatgatttctgtaccactgttttcccagttctcacccttctttctggcaacttcttcacagtctatgttgccacctcttcttccaatgcccctttgattatcctggggtttcatctcagccagtattcagggtcaggtggagagaatcggaattgccaaaatgaaagaatcgggtgagcgtttgcagggacggcttgtttaactcacatttctgtccttggtggccttggaaagaaccagaatttctttggcaccttggtttcctagacagccctgagcacagagtgggctacctcggaagtgtctagctgtccacagcatcattttcctgctttacagtcatgatgcaccctgatatggggggcatgtgtccatccagggtacactttacactctctcctctccctggcatcttcataccgctgtgtggccacattttggccaacaagatgtgagcggaagaggtgtatgaacttccaggctgtgccgttaaagggcaggggagggctttgtactcctcgcttctctccccttgctggctggagtgtggaccatctttgacagtgtagctgagggcaacacaccaggcatggatgatcagtaagatggaagaagtccatggtcatgaaaccatggtagttccaggccagccctgggctgcttttgtgcagagcagagaaagaaagtcctagtttgtttatgcctttgtaagtctttgttatggcagctgaaatttatcccaattattatacaagccctaagtaaatttttgtggaatacatcatgcattctttcacagagtagacaaagagagcaaagggagaaagcacagacatagtggtttaatgcaggagtgggcaggcgccctctgggaacccttctcttctgtcttcgtttgagtggttgtgcactggggtcccattctgttgtcaccaacagtgagcatggaacccaggtctctctctctctctctctttttttttgagacagtctcacttactctgttgcccaggctggagtgcaatggtgcaatcttggctcactacaacctctgcctcctggattcaagcgattctcttgcttcagcctctcaagtagctgggactacaggtgcgtgccaccatggctggctaatttttgtatttttagtagagacgtggtttcaccatattggccaggctggtcttgaactcctgacctcaagtgatccacccacctcagcctcctaaaatgttgggattacaggcgtgagcccgggtatcttatacacaggcatttcaaagcttcaggagaggccctggccaaatgttcctttttattttattttctatttctatttatttatttttttaaagagacagggtctcactctgtcacccaggctggagtgcagttgtgcaatcatgactcactgcagccttgaacttctgggctcaagcattcctcccacctctgccacttgagtagttgggactacaggcgtcaccacatccagctgattttatgttctttttctttacagagggtctcccacattgtatgacacctgggcaataaaaaacggattctacccctggaaccaccatttctgtctccccattagactgtgagcttcttgaggacagacgagtgttgtccccagctgttgcactggtgccaagcagattgtacatgctctacacaagtttgctggattgaatttaagaaggttggatcaagacctgcttataatttgggaggggggcaagaaactagaaggaaaaacaagagagttccaaaaaaaggcaaagaaactgtttcaaggaaacttgtcttttataaggtggatatttccatgcattcttgggtaggtgctacgctctctgagggttactgcctgcctcacaagttcttgagaaccggaagaattccaggattctggcgaagaggggaggtggtctggagcctcggtgggtgggtgctggaggggactctgggatggtcctcaggccagagagggtagttggggtgagagggcactggggacacagccctgaggatggtgaaatggctgctagcctgggcagggagtcttggcactccgctttatttactggctggaaatccctccaagggttcacaaagacaagctgaaaacaggaagccctcaatgagctgtgattcaagattacccatttgctgccccaggggctatgatggggccactgtgaactctccaaaacagacccacccacacccttgcctccctcgcccctcttctcccttctcttatctcctctctccttctctctctcctttctcttgcgtccttgccttctcactctctcctccctcccttttctcccctttcctctaacactccttgccttctctcttactctgttttgtttttttgttgatgttgagacagagtctctctctgtcgcctaagctggagcgcagtggcacagtcagggctcactgcaacctctgcctcccaggttcaagcaatcctccaccttagcctcttgagtggctgggactaccggcgcatgacatcacgcctggctgttttttctttgtcgtattttttgtagaaatgaaatttccccatgttgcccaggctggtcttgaacacgtaggttcaggcgatcctcccaccttggcctcccaaagtgctgggattacaggcatgagtcaccatgcccggccactcttccttttgcttttaatgccatctgtttccctcttgcacctctttcctccttgatttttccttgttgcttacttcttctcttatctttctccagcctctcccttccacctccttctctgtctccttcagttttcctgacctcttttcaatgttgccattcttcttctccttctcatttcttcttcattccttcctctctgtctttcctgcctccttcccctcatggtctccccattcaggttctcacactcttctcctctcttgctttctgaattgctttaccctcttgtgtgcttgtgtgcacacatgtgtgtatgtgagtgtgcatgcatgcatgtgtgctctgtcctgaggctgagcaaggagggagagtggaaacagaggcagagaaagtggagagaggagtcaggatgcaattccaaatcttctgaatgggttttggctcagaggtctcctgttccaaattacaaaatccaacccgggatgggaaagtcatctacatacttagtagactgtctgctatttgcttgaatatctccaatagcagggagcttactatcaggcagggcagctcaatcccttttaggaaacctctaacctgttctggtgtatatcacaccaggaatgaatgaatggccctcgttattctatggagtaagtcttagccctctgccttgtgtctgcacttcatccacttgaagagagccacccaggtgtgcacaagtcattctttccttaacccattcctaatacgagctgcttccaggcccttcaccatcatgaaacgcccacatttgacaacctcttaaactacataatacccagaattacacaacagaccccaggtgtggtttcaccagcagagatcagataagactgtcccctccctctatccagaatccacctggcatattcctgcctcagggcctttgcacttgctgttccgagcctgcatggggtttcaccatgttggccaggacggtcttgaactcctgagttcaagccatctgcccaccttggcctggcaaagtgctgggattactggctgagccatggtgcctagcctcaggttattttattttattatttattattatttttttgagacggaatcttgctctgtcgtcaggctggagtgcagtggcacgatctcagctcactgcaacctctgcctcctgggttcaaacgattctcctgcctcagcctcctgagtagctgggactacaggcgcccaccaccatgcccggctaattttttgtatttttagtagagacgtggtttcaccatgttagccaggatggtctcaatctcctgatcttgtgatccgcccgcctcggcctcccaaagtgctgggattacaggcgtgagccaccgtgcctggcctaaaatatttatatttttatgccacctgttctagaaagaatttatggcaaatttcaaagatatataacatacaacatgagacgtaattaaaagccggatgatagtaattccactattaaacatccatcctaaagatataatggaagacacatgaaatggtatgcacgcaaggctgtttattgcagcactacgtgtaaaagaaagttttctgtcaacaattgggccatgttctatgatctcagaggtttatagctccaccttaagccttgaggacaggatgaagttagatgagaccctgaagacaggggtgggcggcctagagctgtggatggagctggagggatgttgggatggtcctctggccagaggaggcatttgggataagaaggtatgtagggcggactgccaccgggatggtgcattgactgctgacccacatgctcctcagcaggggacagctgcatccatggtgctccatgcacacaatcgaatgctttgcagtcaagagaaggcaatgaggaggatctacatactgctatggcgtgaaaaaaatagggtgcagaataatgaggataacatgcaagctttttttttttgtttgagacagagtctccctctgtcacccaggctggaatgcagtggcatgatcatggcttactgtagcttcaacctcctgggctcaagcaatcctcctgccgcagcctccccagtagctgagactacaggcatgtgccaccacatctggctaattttttattttttatagtgacaggatctcaccatgttgcccaggctggtcttaaactgctgggctcaagcaattctccggccttggcttcccaaagtgctgggattacagacattagtcaccatgaccagccaacatgcaaacttttatcaagaatttttttgtggacaatgcacatatttgattaaaaaaatacaggctgggtgcgcaggctcacgcctgtaatcccagcattttgagaggccaaagtgggtggatcacttgagggcaggagtttgagaccagcctggccagcatagtgaaactcagtctctagtaaaaatacaaaaattagccaggcatggttgtgtgcacctgtacttggaaggctgagggaagagaattgcttgaacccaggaggtggaggttgcagtgagctgagattgcaccgttgtactccagcctgggcagcacagcgagactctgtctcaaaaaaaaaaaatgcaatgaaggaatgaaccaaaaccaaatgagaatgttacctatagagggaagggaagcgggaggtgacggggatggaggctagtcctcactgtatatatcttgtttttataattttggctttggaatcaagcaaaaatggttattaattataaaacaaaataaatcaactggagaaagaatttcctgaaaacagaaaacaaaataaagttagtctaacaatatattaagctagtggcttaaacttacagagaagaattatttcaagtgactttgtaacagaaggctgagcacgtggatctctgtgatattccatttcttagatgaataaattcttactattacttataacccacagtattataatatacttatttgactgtccttcacactagaatttatttcttaacagcctgatcagtaattggcacatggtagatgttctataatttgtttaaccacattaaaaaaaaaaaaaaagctcaacacaacagtaactatatatccctagcagaaaatatccaaaagattttttaaaactgctaagaaatataaaattttattcaacttgttagtaataataatggtattgctattttaaaccatgataatagtaataatgctattaggacccaagatttttaaatataagagaaaagagatacaattttaaaataaaataaataagtgttgtaatctaagatttgaattcaaaatatcaggatgaatttatgatgtatttttctcttaaaaacatatatgcatttttccctgtgtctgccaaaaaggcctagaaatggcaaaaaaaaaaataagaataaacatatttagcacccagattgtggtctctaaaacccattatgttattgaaaggcttccatggctccttggggaaatgactgattccaggtttgggcagaaaatgtacaagatgagttcaaaacatcttatcatgctagtaaaaggaaagctaccatgtcaagaagacacataaatcaactcaaaagggctcccattagccaaagatgggataacttgagtatcagaaagaatagtgacttcaatagattgaaatacatcaaattgttaataaccaatgacaaaaagatcattggtcatgtttggagggtgctaagacactatctcactattccaaaataaatgggtaaataacagtgatgaagaaatattctctttgatgttttctagctactaaatgcaaaagaaatagaattaggacatcatccttctgcagcccctaatgcaataacagattgaggcaatgctgatcaatgccaaggccactggggaaaggctgatgggaaacttgataatgtgtggatcaggcagacgatacctgagctcaaggaccactcttgacatctcaacagagagacttgccagtcagatgtgatgcaagataatggcccctacccccaccctgcaccagggaagtattcttgccagaatccagaacctgattcagataaaaatctctgcatttaactactagtttacaggaaatgcaggtgatagaggaacaacatggagctgccattggccaaattagcatgtaggaaattctacaggaaaaatggcctccccccaccaacaaataaatgacaaggaaaaaaaaaaaacagaggagactgaactgttatagatcataagaggcttatgtcatactaaccatgtgaatatgaaggacttgtctgcatacaatggaacacatcaattaacaggaggctattgaacactgatgatatactagatgatattaaagaattattattatgtttttaggtctttggctacattagagacaaaaaaagaagcttttgtgtgttagaaatattcactgaaatatttatgggtgaaatgacttgatatctgagatttgctttaaaatattccagtgatctacagagacaggaagcagaggagcaattgccaaggacttgggggagaggaatgggtagtcactgctaattgatgtgggataatgaaaatgtgctacaattatacagcggtgatgcttccaccttgtagatattctaaaaaacactgaaggccaggtgcggtggctcacgtctgtaatcccagcactttgggaggccgaggtgggtggatcacgaggttaagagttgagaccagcctggccaacagggtgaaaccctgcctctactaaagacaaaaattagctgagagtggtggcgggcgcctgtaatcccagctacttgggaggttgaggcggaagaatcgcttgaacccgggaggcggaggttgcagtggagcaagatcgcgccactgcactccagcccgggtgacagagtgagactccatctcaaaaacaaaaaacaaaaaacaaaaaactgaaaacactttagaagggtgaattttatagcatgagaattagatctgaaaaaagtatccagaggtgtttgagaggaagattggagatgtacataaaatataattgagcatcagtggataatggttgaagttgggtcaaaggtttttcttttttttttctttttttttttttttagtgtgaggctaaaggtacatggggttccagtttaccattttctcttcttttgtatatatttgaaacttttaggttaaaaacaagcaggactaaaggagaaaaacaaagatgaggacataaaattgtacttagactggggttaacagtggttatgtctggatatagatgtggccccttttttgtgtgtctgttgaagaaaagaaactttgatcagtaacatgattcagtctccctaagaggaaaaagcacgaggtgcctaagagatttacaacccattcttgcaataaaatcatatgatgtttctcctgagctcctcctatagaggacactgcgatatgtaacaaatgtaagcctcaacaatgctctttgatgattggctgtttcctataatgtcacttagttaggcttctgtcttactctactggagctactatcacaaaataccagagactaggcggcttaaacagcagacatttatttcccacagttctggagactgggaagtcctagatcaaggtgctggcatggtcaggttctggtgaggcgctctgcctggcttgcagattgctgccttctggctgtgtcctcatgtgccacagagagagagtgagcaagctctctggtatctcttcttataaggaccctcatcccatcatgagggccccaccatcgtgacctcatctaaacctaattacctcccatagatcccatctccaaatcccatcactttggggattaaggctccaacatatgggctttaccggggacacaattcagtccagagcatctcatgtcctcatgtcctctccttaaagcatgattcaaagaaagcagtttgcagatggccaataaatgcaatgcagtgatcattttgatccgtttttaaataaagcttattaattacttgaaaaaattatatacagacatggcaaaaaaggtaaaagatatcaaaaggaaatctggaaaaaaaataattctaaacctcaagcctcctggtgataagatttctttgtacttgtctggaaatattctataaatataataatgtaaggtgatagaaatgggtctcattctgtctcagtctgaaatgaatcaagaagacaaagttgctatttcccaaagtgtgctatgagagactgctatagtcaagacctagcagactcacccatgtattatataacaaggttaggttgctggagattagggaagttttttgaaatggtggtttctttggaaaatgttgtgtcagcctactctggccttttggtagataggtctggtaagagagtctatgggacacccagtgaggtggggcctggtgaactggtgctgatccctagggcatctgtaggtgagcatcccagcctttggggttggcccacatcccagagtttatccaggctcagaatgcaaatgcttcctgtggactacagttgggctgtatgggagaaaggctggctttgagccacttaaaaatcttacatgggggagcagcagctgaaggagagacattgccacctccactgccaccaccacggtccacaccatcatcatccctcactggaccatcgccatcatctcctttgaaaattccccttgcccaggccaaatgtcaggcttatttcctcaaaatctccggaggtaccagtgtctgttgaagctctgcaggcagatgtgtgcagcccaggttggagaggtggtgtctggccatctctcttttgcgttcagccaaacttggtcctgcctcagtgactttgcacttgctgttcctgctgcttggaacaattttcctgaatattgtctgtggctggttgcttcaggtttcagcccagatggtccctcaatacgggctttttccaagtacctgatatacagtggccactcctccctgtccgctctgggaagtctctactgaaatcccctggtttattatcatttttgttaccaccttcacctctctgaaattacttgtctgttaatatatttactgcctttctcctccactaaaatataagctcataagactaggaaccttcagtgtcttgctagggaggcaatttaccagcatgtttaaaaatgcaagctctctgtccttaggcatccttagtcacctgctctgtaaccgtccttccagccaaactattcaccccgccactccggctcgtacccctgctttctttaaaatagccaatcggaattagcttagactgtatggtccaaccctagccaataggggaaagacacagcagtaagaactagctgcattaggaataagacccccttcccctcccttgtccggtgtgctctcgccattgctccatctgcgagacacacccttctctagaagtaaaattgccttgctgacaaaaaaaatgcaagctcaaatcccaactccatcacttattcgctgcatggccttgggtaagttacttaacctctctgtgtctcactttcctcatcaacgaaatgtggataacttgaatactggattgctgttgagcattcaatgagatactacatgtaaatgcactaaaagagcacctggctcatcacaaatgctcaataaatgttataactatcattattattcctttttatacccctagcacccagcataaggcctggcacatagtaggtcctccataaataattgctgaaagaatgaatgaagaggccagtcatgagaactgtggtgggaagagagtctaggccgaggaaaaaaggaggtgcaatagccctgaggttgatgctgaaactcacaagctgtaacagaaaactgggtcttaacatcctcttacgaaagctgaaggctaatagggaataatgcttgaagaggggacatcccatctcccctgagagaggaacacaaggagtgaggccaagatccttcccagaaagtgatttggaatcaatcctgatacagaaacacataagcaactgaagcttattgccctatttcaatcacccagaaaacatttaaggcaaccatgaccagttgctcaccctgctgagtttctctccagcaagcctccatagaagtcccagcttggagcatgctccctcctggtgtgatggccgggacatactggtttttttaaagtaaagataactgcatgaggtaatttactgaaccaggttatttacaaatcagtgaaaagtcaggaggatgcataccaaaaataatcaccataggttcagaacagtcactctgtggcctttctttctggcaaaaattagctggcagggccaactggatgttcaggccactcctagttggagataataaaaccataacccgggcacacaaatggatgcttgttttcctgtttttataacaggaaggcatgcatccagctcattccaaaggggtatcagctcattaagaaactagtcggatggggtcaagggggataaactaaatctctgttttacctcccaggaaattcttaaccagcctgcatgtcccagactctcaagacaggattaagtacaagttctgtgtgacgaatattaataccaggtcatgctcacagagtttagctcagaatcaattcccgagctcatcaaaggcttagaagcagcaatggggacttgcaaaaaccctaaagcagaggttcccaagccttcttggtttatggtgcccatctcaagaattttttcacggcattcttaaggccaaagaagtactaagcagattcacgtattaagtagttagagcgaaatagcttattaagtgtttacatcctaacaatttagtaaccatttgaaaaaaagtacggaatgtttttatttcattcctaaataactacaattacttactaatgggatgtatgtgcttattgggcagtgcacaaattcctgaaccttagaatcagattggacaccattaccctcatttcctctcccacgtgattttcacatggtacttagtttttggcacaaccaccaccaaaaactcagcttcacaaagatgcaacatcactgaaagaaacatacgatccaatctagaaacgaaactacttcggccattaatttacatggcgtctgacagacgctgagaattgctatgtttcctttgaaaattaaaaatatactgtgctacccccatgagtctgtggcgctccaggacttctcagtgtcgagtttgggaactggagccctaatgtgatgacttttggagttctcctctaacagtaaataacagaagtctctggtgttatatcccagggaaaaaagcctgactgctcctcatgtaaaacacaggtctgagaaacctatggggtgggctggggggaggaggtatatccatatacccaatgacccaatgacccaatgacccaatctataggtttcctggtttttttttttttttttttttttttttttttgtgtgtagagatggggtcttgctgtgttgcccaggctggtctcgaactcctggcctcgaatggtcctcctgccttgacctcctaaagtattgggattacaggtgtgagtcactgcacccagcctagtcaatctatactttaaaaaagtccacactttaggaaaattaaaaggatatcacactttttaagatggtataaactctgttcaagatagatgcatcaggaccatgttcttaatgcatacaaaggtgggttagttagtgagagtaagctcgctatttagaatagtccttaaacatatctgaaaagaaaatgttgctcaaacggtgtattaaaaagattattaaggtaccatttctatcatgaaggagttcacagtccatgggagaggcagatacatgaacagataattctatagagggtgaccaacaccacaaagggcatgcggctgaggggccctgattcacaaggggaggggggatgggtgcagaagtcttccccagtgaggggatggagtccacctgaattttctttgtaatgattatggagattaacctgcaaaataacaattcacagtgggtgttggcatggggcttcatctcattttcacactcattctttcaagacatctttcctgctttttactgggcattaactatgtgccagcaactgtactgcacagtttacatgtattatctcagttaatcttcaaaacaactggatgagcctctggccatgacgtatccagacaagccctgtctctgtaaacaactataaaactggaaataatttatgagccaactgtttctaggcagcagaaataggcaatgcaaggctgtgatcctaagaagaggggaattgggaggggagcctcgtgttcacccggtgcctttcccagcctcgtcacatgccactctgcccttgcccgtgacactccaacttactggtctggcacttcctaaacaacccaaactctttcctgcctttgggcttttgcatctgctgttctctgcccccagaaagttcttctccattgttctgtgcctggctggcttgttgtcacttttcatatgttttgtgtaagtgtcaccaggtcagaagttttttctctgatagttctactgtgtttttctctcttttaacaatctcttcttctcaccaagaagtaccaagttgagtttgtaactgtgtatttatttgcttgcttttgcattgtctgcctattccactagactatgacttctctacccagggcttagcacagcacctagcacatagtaggtgcttaataaatagctgttgaatgaaaaaaagaaagaaggattagattggcccctctccttcctggagcaagtgagggaatgaggagttaggaggaaaattaggagaaaggcaattcctccttcctctttacaatgttactgaagctcagaaaccctgtaggatatagctgagaaggctttgtgaaggattaaagacatgaagacagtgtatgtccactcagtagagcctcttggcaatcttgggagggagatgttgttcctcccatttcagggatgaggctcagagatgcgaagaacttgcctgaaagcacccagctagtaagtggaggaatgaggatatgaatctggtcctggagaattcagaaccccatgatctgtccatgatcttgccctggtttgaatgcagaggatggaggcaacttttcccttttcctatcttttctctttcctatcttttcccttccccacttcccctcatctgggtcttctgcaaactccagtgacagatgggcttgagctggcaaagtgcaggttttgagagtgccatggggcaggtgcctagtctcttcctggaaggacccgggagggcaagctgtaccagccaaactctattgccaaggtatcccccactggaatcatggccctgatgactcaacccaagggccccttagccaaggcagactgtgccaggggaccctaacatggccggggctctgggctgactcacagggcaggctgccaccacctgagtcacccgccccacctctgactggagagaagaggctggggaggctggggtggggcactggtctgggaccatgtgactcagcctgtgaataaataatgatgacagtgattgtaataacaaaaatgatggacagtgacagctacctctaacgagtgctttctatgtgcttggtgctattctatgcactatatacagtattcatttagtcttcataacaatcctatgaggtaagtactactattcccatttcatacatgaacaactgcggcccagcaaggttatgtcattggctgcaggactcacagctggaacagaaaagctgagatttcaactacgtccgtctgactctaaagcccagacattcattcagttaatatttattgagcccctactacaagccagacactgttgtagacaccaaggagacaatggcagggttgggtgggaagataaacaaatagatatatgacatattaggtggagatgagagatgagtgctactgttagagtagctagtcaggcagacatgaggagggccaagagggctcttccccatccaccagaaatgtcaggcgactttcaggtgatggtcaggcagtttttaattgtctcgttaaaataataattggttgcagctggcaccagagaaaggcagtctcctaatggatagaaaaaaccttggccgggcgcggtggctcacgcctgtaatcccagaactttgggaggccgagatgggcggatcacgaggtcagatcgagaccatcctggctaacacggtgaaaccccatctctactaaaaaaatacaaaaaaattagccgggcgtggcggcgggtggcgcctgtagtcccagcactctggaggctgaggcaggagaatggtgtgaacctgggaggcagagcttgcagtgtgcccagatagcgccactgccctccagcctgggagacagagcgagactccgtctcaacaaaaaaaaaaaaaaagaaaaaaagaaaagaccttaaactggtgatcagcagcttcctgattagatctcaggagttgggtgagtgggctcaagcctgtgcactaagaggcaaaatggcggagtgtatgtaactggtatatgaccttcttctaggaacacgtgactgggaagggcaaaacgcctccagtgagcatgcgcacaacttcagtaaacacactgtgcctgcagcccctcccaagtgctggcaggccactgcgcatgcagacagcccacctcaagggaagaatcaggggagaaggaatgcaagaccccggaagcaaccccaagtcaaaggtcaaactgtgcacttgatctctcaagttgcccgactggccctcttccaagtgtactttacttcgtttcattcctgctctaaagcttttaaatacagtttcactcctgctctaaagcctgcctccttctttccctctgccttaggcctcttggtcgaatttaaggcaagaatggaggttgctgaaggttccactgctaacagtatggggaaaataaattacataaagtggggtagggatgattggggggtcagacttgggacactatttctcatagagcagctggagttctccctaataagacgtcgtcgagtaaagacccaaaggaagtgcagaaacaagtcacaggcctatcctgtcgattccaggcagacaatagcaagagccaaggcctgaggtgcgacattgacgtgtgtgcttggagaagaggccgatgtggatgcagcggagtggagggagggctgagaggtgggctgcaggtcagaaagatggggaagggtcatgtagggtctcagagccaccgcaacgactttcgtttttactgcaaatggcatgaggagccacggagggtttcaagcaagggggatcacatgatctgacttatggcttgaaaggttcgctttgttgtgagactaaagcaaggactgaaaagcaagggacctgttggaagcccactttcatcatagaatccccatgagaagggacagtggcttgaacgagggtggtacattctagaaatattttaaaagtagagctgaaaggatttgctgatgggtaggatgtggggtgtgaaggaaatgcaggagtggaggatgattccaagggctttggctggagcattttgaaggcggatcccggctttcccctcctcagcccacccacaaatgggaaagcctgcggaggagcagttgtgcccacgatcagagtccttgtggacagccccagtcagacgacagagaaagtctccctccaggtttttcctgctcctagtggatgggaacagagacccctgaagcccagaatgtcacctgcggccagcgtaggtcaggggaactcgctcaagaaggaagttgcccctgaggccagcaggagagacagacagagcctagggcatcggtgacttcactgagacactcatcaccaggacttcatggtgtttaggccagtttgaactggaattttctagtatttacagccaaaataatcttgatacagggtaggtgccttcactggcttctggctgcccaaacctgcttggcttgcctatgggtgtgtctgcagagaaggtatttttgctgaggctctagtctccagaatttgtcactctggagggacttggggggtcctggctggttttcttcagcagcagaggacctttcagttgggggaatgataatgggggcatctcttatttccaaactctggcagtttccttccatgtggagggaacaacatccctggcctgtcggctgcctgccactcacccgtccccggagcaggtgacattctgatcagagagtttgaaggagaaacggggcaagtgtggaccagtccattcttctcttctttctgtttcccacgaagagcatggaatctactctgcttctgactggagagtttgcaggccaggctcctacgtggggaagcctgtagaggcccaacgctgcctccaaggcttgggggaggcaaatctgtctcattctggggttaagtcctgaggagcccatttgcctgcacagcaaagccacattcctccacatcttgatttctactaggtgatatatttgattttgcaaattccttcctcttacgacaccccagcataaacctgcaacgtggctgactggttggaagagcatattgaaggagtgaagccaagcatgaggtgggttgaattcttcttccaatccgagatccaatgattctgttatctgacaaaaagaagcaccccggttctgtcaaagagataacatcccccccaatacttaattctgaaaggcacatattcaatggttcgtcatgagactttgcacagtggataacaaatagcaccattgctggtggttttataaaagttgccgaaacgtctccagccgactggaaccttcctcccgccctttcccaccttcattgcatgaccccttggctttgtcaggctgaggacagggcagcgggctcctccagagctcattaaggtttgcttttcccttgctcaaagtgatccttggtaaatttcctcttcagggtctgagaactcgacctttagtcaaggaaccatctgggttggcctggagggacattgctcacctgtgaaatgattgccccacagtgaccggccctgacagagagctcctctctccctggtctctgcctaatactccccacaatctggtctttcacggggagtgcccgacagtggacttgaccggctctgccccctgtcagcacttcctcactaagccgctccaccctactccgttttctgcccaacaggagaataaaggaagcatcagagcctcccaggcgagattccagattgtctgtaatgaaaacagaccaagccaagcaaacaaagcagatgcttggcctaagccctgcttattatttcaatcttatatggacatttcattgcttcgggccatgtctgcaggtgattggcccagggtccttcctttctgttgttggggggcatcagcccaggctttcatgggaaggacacaggatcaaccaggacaagggaaagaagagccagggggcctgaactccagttccagctgggaagagacctcactgggtgaccttgggcaagtaactttccctctctcaactctcagattcaaatttccaccatgcaagcatagggtataaaagtaaatcaaggttaagagagtggcctctggagtcagagcatgtggctttcagttctgactcaccgattgccataacctcattgcgttcccactccttcaactgtacgctggttattagtatccagcttagaggcactataggtaagaggtttaagtaaattaactcatgggaagttctccaggcagggcctggcatgtagcatgtgctcaatacattcatcatgattattatgaataatcctatgaagatcacagcctgtaagggcaatgagacatgtcaaagttaagtacaccagcagattacagatggggccccagaattctgcataaacacagtgtggatgcaaagcagggagggtcatgtcaactgaaggtgttggggagaagttcaggaaactcttgaacttgagctgagtttggtcttgatgaggctgacacaggtgtaggacactcgtggaagataaaatggagggaaaagccagagaacatggaacagcctggcatgttccgggattggagagtggttgggtgtggctggagcagtgggtgtgaggaggcatgtgccgagaggaccctggaaaagttgatggatcagggtggatcctgtaggctttccccttggacaacctggagtcctgctagtttttttgtttggagacagagtctcactctgttacccaggctggagtacaatggctcgatctcagctcactgcaacctccgcctcccaggttcaagcgattctcctgcctcagcttcctgagtagctgggattacaggcatgcaccaccatgcctggctaattttgtatttttagtagagacagggtttctccatgttggtcaggatggtctcgaactcctgacctcaggtggtctgcctccctcggcctcccaaagtgctgggattacaggcatgagccactgcgcccggcccctgttgggtttcaagcagaggaagtgaggtagccagttctgggttttaggaccctagcaaatggatgggaggggccagctggggggccacgcaatccttaggcagtgattgttgcagtttagagcagaagtggtgcagagctgacctaagacaccaagatcagggaggcaggaaaatgcaacgcatgcctgagctgggaacacaggactcaatcatggagtggctgtgagggcccaaaggggagccaaatgatagaaccatttgccggccatgactgcacgtctttcatactgggagtcctgccctgctacagatgaagaggccccgggagggttgagtcacttcttccaggtcacatagctggtgagcaaaggagaaggatgcctactgggaatctggcttcgcagctcccagccataaaccaaggctgcttctctgtaaccatggccagcctttattgaatgcttttcatatgccaggcattgttctaagtaactttcccaaggtcacacggctagtaaatgacagagctgtgattcaaacacaagcagtactcccagactgcacccaaacaatgctcccggactgtacacaaacagtgtcccagactgcacccaaacagtgctcccggactacacccaagcagtactcccagaatgcacccaaacggtgctcccggactgtacacaaacagtgctcccagactgcacccaaagagtgctctcggactgcacccaaacagtgctcccggactgcacccaaacagtgctcctgggctgcacccagtgctcccgcattgtacccaaacagtgctcctgggctgcacccaaacagtgctcccgcattgtacccaaacagtgctcccggactacacccaaacagtgctcccggactgcaccctaacagcgctcccggactgcaccctaacagtgctcccggattacacccaaacagtgctcccggattgtacccaaacagtgctcctggactgcacccaaacagtgctcctggactgcacccaaacagtgctcccggactgcacccaaacagtgctcccggactgcacccaaacagtgatctcagactgcacccaaacagtgctccctgactgtacacaaacagtgctcccggactgcacccagacagtgctcccggactgcacccaaacagtgctcctgggctgcacccaaacagtgctctcggactgcacccaaacagtgctctcggactgcacctaaacagtgctcctggaccacaactgcttatcactatgctgagttgctttgggtgacacaatgatgcaggtgaaaccatgggagtggatgggattgtctaaagcattgttgtctctggaactccagtgagagtcacatgtataattacaagttttctattagccacattaaaaaaagtaaaaagaaataggtgaacataattttaatagtgtatgtatgtatgtacatatatatacacacacatatacatataaaatagtttacgtatatacatatataaaaaatataaattcatacataaaaatatatataaatatataagtatatataggagaccgaatcatgccctgtgcccaggctggaattcagtggtgcgatcctagctcactgcagcctggaactcctgggctcaagcaatcctcctgctacagcctcccgagtagctaggactacaggcatgcaccaccgtgcctggctaatttttaatttaatttaattttattatatatttatttatttatttaatttttttttactcgctctgtcccccaggctggagtgcagtggcacgatctcggctcactgcaagctccgcctcccaggttcacaccattctcttgcctcagcccccccgagtagctgcgactacaggcacccaccaccacgcccagctaattttttgtatttctagtggagatagcgtttcatcatgttaaccaggatggtctcgaactcctgacctggtgatctgcccgcctcggcctcccaaagtgctaggattacaggcataagccaccgcgcccagcctattttatttttttagagatggggtcttgctatgttgctgaggctggtctcaatctcctgacctaaagtgatcctcctgcttgggtctcctaaagcactgggattacaggtgtgagccactgcacctggccagggtattttgtttaacccgatataaaaaaagttctcatttcaatgtgtaatctatataaaaattatgattgagatattttatgttctcttttttgtaactctagtcttggaattgggtgtgtattttatactcagcctatctcaatagaggcatgtgtcaagcactcagtaggtgcacgtggctgatggctaccaaactggacagtgcaagatggagggatctgtggacagtgagaaagagagagggggcaaggtcagaaccgtagggcacatggatgctcaagggaagggtggaagaggagcttgcaaaggagcctgggaaagcctggctggagacaaaggaggaaaggcagccagcatggtgtccctgaaagtgacgtaaagtttgtgtgttaagagatgggtacaacagtgacacaacccggaggagagcaagcaaaacaaggggctgaagactttatcaggattttctatttggaggtcatgaattatctttgccagaccaaactttgtggagtggtgggagctgattcagggagctggagagaatggagacaactacaggctcctttttaagaaacttggctgagaaggtaggtaaaggggtacaagggctcagcaaagacttatttattcttttcaaatctaaatgagacttgaacattctttagtgttgaaagatgcccttcagaaagcaacattgagcgccaggagtgagaagaaacggacaggtagccaagtcctagaggctatgatggaaatgagagccagaactcagaggtaaaatgaaatctacaaaggagaaaagactccactgagatgggaaagaaggtgtgggggcaggcagaggtgcaggaagatgaactttgatacaggggaatggattctcttctttgatgggaaggacgtggggcttgaagagagcagcaaagttctggaaatgccacagtgagactgggaaaggtaactgactagggagatgtaaaagcttcaccaggacccactagggccctgctggggttggagatgaggcatttgtagtaggagcatgagatcagtgatgaggttttctccaactgtgctcagcagtgtcagtttaggaaaggagaaggcccatcggtggattgattcaaggttgagtgttctagggcaggtgcaatagaacgatgacggagatcctccctccctccctccctccctccctccctcccttctttccttccttccttccttccttcaccaaaaatgtattaagggactgctgtatgccaggtactctgctaggtggtggaaatagaacacagagccaaaagagattaagattcccgcctccatggagcttatggcaatggttttctgcaaattctcaattggtccttaatatggaaggggaagaaaagggttatgtattgggcctcagaacattagctaaaaaattgggatggactgatacatttcacatgtggagctggcatggtctactgtgtggtcggggagagggtggctactttggacagtggataccaatcttgaagtcatggaagtagggattatcatccacatatccccagatggggttgacgagcctcagaggcagcacgtgaccagcccgaggtcacacagccaggaagtgggaagattgtctgggcccagagtctgctgtttttactttcctatactcccaagctgatgaaaccccaggaagaggaggtttattgaactccttgcgggtataggttccctgcctccctcctccttctcttgccaaccctgatttgggccagagccatggccattttatgcatcagtgttgtttggagggggaagcttgctaatgaggatgatccccagtttcagaagggaccggacggtcacagctgcataaagtcctctggatgattaaagctcctcacgggacaggcaaggctgttagaatcttcctggagttgacaggcaaaagcacagccagacctttgctcctagctgctgtggagagctgtgcctctgggaggtcctgaatgacaccagcctgggctccctgtacctttgctcttgtttccttcctggaatgctctccttgctcctctacctaattcctactcattcctcaaaaccctaaaactcagttcctcctccagctcctaggaatttctctttcctcctctggacttccacagggctttgtatttagtctacaaatatttattgagggtactgtgctaggcattgggaatacagtcataaataagacaggtatattctagtcagggaaatggaaaacaaataagcagatagtgtcttgggtccattggggttgctctaacaaaataccataaactgggtggcttataaaggacagaaacgtatttcttactgttctggaggctgggaagtccaaggtcaaggtggattcagtgtctggtgaggccctgatttattcctgtaacctcacaggatggaagggacaaacaagctcccagggcctattttagaaagacactaatcccattcctcagggatctgccctcatgacctcccgaaggctccacctcctaattccatcaccttggggggtaggactttagcatataacatattttaacatatctgtagcagacagataggtggatacctagctagctaggttggtaacaaattggtagaaaatagctagtttgcaaagactttgaaagacacaaccggagagtgtcctaggggatgtattactttgtattgcctgaatactgaggggcctcctgaagctaatcaatcaggctgggtttgtagaattccatttgatgggtgtttaggctgcactatgacacacattcttcccatgcaagtcacaaagttgttagaggaatcagaagaaattttgcaggcagcacaatgcaagtatatagatgacggggtcaggatggtctagattcacatcctagcttagggacttacaaatgccatgatttggaatgagttcttaagtctttctggggttcaatttcctcatgtgtaaaatggagatgataatatttatactcaccctcagagagttgggaggattagaaattctatctacctaattctttctttctatctatctctatgcatccaaaatctatctatctatctatctatctatctatctatctatctatctacacctatctatataaaatctatctatctatctctatccatccaaaatatatctatctatccatctatacctatctaaaatctatctatctccatccaaaatctatctatctatctatctatctatctatctatctatctatctatcttctctatctatctaaaatctatcaattgatctaaaatctatctgtatctaaaatgtatcatctatctatatctatctaaaatcaatcaatctctctctctctctctctctctctctctctctctatatatatatatatataaaatctatctatttcttctaggtgatggttattattgcatgcataagagttttaaaaatacgaaatactccacaaatggaaggtatggctttgagcatggtttgggagtcaggctttactacttcctaactatgtgaccttgggacatttcttaacttctctaaaccttaattttctcatccgtaaaatggggtttgtaatagtacctgcttcacagagttactgtgaagatttagaagtaaactggcccaatgatttgaacagtgccaggcacaaagcaacgaatgttagctgtttgtcattaaccgtaagcacctttatcaaaaaggtatctagagattttgtaaagtccaggatacattaatagcattaaagctattgtcctcatttttctggccccgatggcttacgttttctgggcatggacacccctctcccagtcctctgaaaagtgtttttagtacgggccatgctgagggtgtgttaggtgccacaatggctggacttatcttgctcatgcatagcttccgaggtcgattaaacatggtatttaaccaacctccctccacacacactgccttctagggaggactggaaagcctgctgactgtcctgcaggacttgggaggggtttgtctatatccaaaagacagacagtggaggaggatgctgagcgtggggtcccgccaggggatggctagactccttgtctgtctggctcccttgtgaaatactgggaaattaaaggccattgtaaacatttcccaaaagcagtaaagatttttttatgcagatggggatgtgactcactttaccaaagttaaagggtctagagcgttgtgctgaggttaggaagaattggaggtttttgttttctgattaaaacattgaattttaattttggagttgaagctgtgcatgtttctctcccaggtagatctgggagtagggaaagggggtgtagtagggtcgggggaggagtctcaggagggagggagagggtggggtgctgagaagtgtgctctgagtatgccgcatttagcaactctacccttatagaaaaaacagcttagaatctcagtgtgaagggacgtgagttggcatctggtcaaccctctcattttgcagctgaggcacacagggaggagcaggtagcttggatagggttacttacccatgagccaaagaccaacactggcttcaagcctgctcagcactgggatgctgacttctctctaccagtgacccacaatgcgtgacactggtggcccacaggatgatttaggggggacacaaatgaacatggataattttaacagttagatatttatttcaaggtgtattaggaaaaattatctggcccataaaactcataatctatggtagtgatacaaaacaccatttaaaaatatatttaagcagagcaagagggaattgtgtgtgtgtgtgtttctaaaatgttggctaaataacagaatgggtgacctgtagggtgtcctaaatcatgaccacagtccactccatctttagggcttttggtgctacaggaggcagtctgaggaaggcctttcaggctctcctagagttttaagtctgagaaggagcaaacttccccagagcatcccccctccccttctcatcctcctttcttctccatttctctcctcctttgactttgtcttcttcctttccatccccagtgcccagaacaaccagtaggcagcgggagtggctggccctgggttgctctgggaggtcaggatctgcctcactctacccattccaggagcttggatttatgtggcaccctggccaccaggggcaaagcctcaggccttttgctcatcctatctccaggcatgttaagctcactccatctatcattttggccagggcttcctaacctgtgaagcaactcagcctaagctattaatgggttatagtggataaatatgtaacaagcaacctcctcccacaacccttgacctatggcgatggtaccttaatacaccttcaagtccttctcccaaagtcataattaaaaaataaaaccaaaagactatgaaaggtggcactgtttatgtgtgggttctagctagggttaaaataaaatgaatgaaagttcttctctgccagccttcctaagaacagcaactgcaggggactgacttcgagagtcttatctattgagtgtcttctagaatcaaacccttcatgaaggcatcagctttgttttgttcaccactgcatcctcagtgcccagaacactgcctggcactgggtaggggtttagttggtatttgttgagtaaactaatgagagtatcaggctgtgtgctcggtgttggcgctccagttgtggtttctgcccttaaggtctagcccagaagaggaaactgcagatggtgagatggtgcagtaagatggggctgtgctaggcccagagctcgctcacaggagggcatgaatcgcatcatgcttgggcaagcagaggaggctttaagcggggaaggtacttaagttgggtcttgaagtatgattctcaaggggaaggtaggctatgacgtgatctgaggtgtataaagtacaggtaggtttgggagagcttggcttaaagaggagttaccatttctgcccctggagtcagattctggctccttccttcctttccttccttccttcccccctccctccctccctccttccttccttccctcccttactcccttcccttccttccgtccctcccttccttccttccttcccttacttcccttccaccctccctcccatctttccttccttccctccctccctcctgtctttccttccttcttccttccttccttccctccttcctttcctcccttccttccttctttctccttccctcccttccttttcttccttccttcctccctccctttctctttcctcccttccttctttcttttttctctctccttctctttccttccttctcttctcttctctctctctttttttccttctgacacagcatctcactttgtcacccaggctggagtacaatggtgcaatgatagctcaccgcagccttgaccccctgggctcaagcaatcctcctgcctcagtctcccaaagtgtcagaattatagatgggagccactatatctggctctctggccatttctgacaatacaccagccccaggacttcagcaactccagctcgtgtcttccactcctctgttccccatctcactctcactggccctccttggctccagccaaagttatcagggccttgcgttgccactgcgggtgtttgttttcagatgatagcattcgagggggctcgactcaagaacaccaaccatggataagggctggaagcaatggtgtcccggagctggctcagacttgcttataagaggtgattgttaaatatttagacatcttgtcagccagttattagatcattgttaggttgaaatcatttgtggtggaaatatttataccccagaaactggcaaacacaacatattagggttcccccctgttttccccagagagccagtttgccagcacaccactggctggaagacagtttatgactgttttcagtattccaggtaaggatatgacatgttgcacaaatggcttgattgtcattttgttaaaataaaatatttaaaagcttgactttaaagcatccaaaaaggacactcaaatgttccacacacatgagctgcctgggtgaccttttctggtgcaatcctcagaataaggcctctccttccatcttggtttatttggagattgcagagaaagccggtaaaatactggtgattttgtcaacactatgctattcaaggacacaaaatagaaagggaagttgggtgctgaggctaatataggactgagttcatcaaaagggccttattgttctcttgatgaactctatcatacatgttgtaaatgaaaagttattgaataaaattacagctaatctaatgctacttttatccatgatttcaagtttcctgtaggatttcatgcaaaaggagagttttgagtggcccagttcactcatgttttgaaagaggacacagcagcccccgagaggaagtcactctgttttggtggtacaactggaaaggaaaaggaaaggaaaactcacaggggaaggaaggggtttttttttttttttttttttgggagacagagtctcgctgtgtcgcccaggctggagtgcagtggtgtgatctcggctcactgcatcctccgcctcccaggttcaagtgattctcctgcctcagcctcccgagtagctgggattacgggtgcccgctgccacgcccggctaattttttttttttttttattttagtagagacggggtttcactatgttgcccagactggtctcgaactcctgagctcaggcaatcctcccgcctcggcccctcaaaatgctgggattacaggcatgagccactgagcttggctggggtttttttatttttaagttaggactctcatctccctctcagggccctttccttgatgaggaaagaagtgaaagtgtccaaatttcattattttggcaggaaataaaaccaccatcgtgagccgggtacagtggctcacacccacaatcccagccactcgggaggctgagcaggaggatcgcctgaggccaggagtgtaagatcaccctggacaacatagtgagaccctgtctctaacaaaataaaaaaagtagccatgtttggtggtgcacgccagtagtcccagctacttgggtggctgaggtgggaggatggcttgagcctaggagtttgaggctacagtgagctatgatcacgtcactgtactccagcctgggcaccagagacagactccatctctttaaaaaaaatcaccatcgtgttcgatgccaacagcacctgaacacaacccacgcttgctagtgtttcataacatgcacctacaggggctaatgtggtttagccttgctggtttctctgacctcatctcctaccacttgccccctccctctctcttttacttcctagaactcaccaagctcagtgttgcctcagggactttgcccttggtactccctctgcctgcaaagctctcgctgcagccagtcccatagctaggcagcgccttctcatgatctgaatagctgatggatcatcccatctaaagcagcccatctgttactcccagtcatatgctattgcattactctgttttgtgtttttcctcgcacttagcactgtctgaaattattttgtattaatagttttctataccctccaaaataataagcaaaatatgggctctatgagagtagggacttggtcttttaaactcgcaaatgtattccctgctccttgcacactagcaggtgtttaggaacaatttactgaatgaataaagggatgctgaccctggtacctaggccctcttttgacctaagcgggtggttttcaaactgaattctatggagggaatggcgccatgccgggagcccggctgggtgggtctctagatctcttttcttttttcattcagaacagctccactaggatctgtttaatatactaagtgttttcattgttcattggacaaagggctcaaagtcaaaagagcaaagccaggtcactgttgaggaagcattgggtggaaggttggacgccacatctttggaagtcctctttaaccccaatacttgtgattccatgaatgggacacaagtcgagtcagctttgatattgagatgcggtggcaagaagagaaggaccatgacagacgtgttctggcgagggagtgggtgggggttccccaagcatgggggtgggggtcttccagagggcggcagcctggttctaagttcttcctgcagctgcctcagctacctgcccctgagtcatgacctgcgatgcactggctgatgcttttagctgaggccacatttgaggatccagcattttccgaccacaactttaaacataatgtttgctcctccactcaccaagagagcaacggtcttgctctctgcggtctcattaaataggattctattttcacagcactcacttttaggacattcttatttgctgttccaggctctcggagaggcagcccaagaggcgctgctgctaaaatgactctgggcacggtagagatggggagatacggaaatgaatagcagctttgtttatttggcatgggaccaggcaagaggagctatattaaaaaataaataaagttccccttctttcctcaagacaaaaaacaaaacaaaacaaacaaaaaaaaacaaacctattccggctgcgtggccaacaacacaatttccctcacagaacagaacagatgtgagtacattgagattaactttgtaggaagaaatttaaaaaaataaaataatgatgagcggtcgtgggatagggctggtgagggggtaatatcaagagtatttgagatgccctcattaggaagccggaaataaaatgaagcaatggcctgagtatggttctatcgacatatagacactctgaggcacccacatatccacagggctcccaagtattcctgattccctctctcgcagacctggcttgaggtcttcccacagtggggaagagataataactattaatagtatggccattctctgagcattcaccatgtgccaagctctgtgccgagtatcccgtgcacaccataatggatgtaattcaccattcttcccactggcttcgcttgtctgagcttcagttttcccttctgtaaatgggtttaatcagattacctaccccagagagctgctgtgacaactgagtaggaaaacgcacatgaactacgaagcacagggcctggcacctagtatgcggtcaataaatacacggtttatgatggtgactattttccgtaaggtatttcaaattcaaaatgttaaaacctgaacccattctctttccccttcaagccattttttcttgattgtacacttcagtaatggaatcgtgataatcttgagttcttttcccgcctggcacagtcagttcccaaattcattcaagtctgccgtttttcatatcactcgactgcatccttatctcattcctcacggccttgcttcctgcctgggtacaaacccttatcatctcttctctgaactgccgcagtttcttcctaatggggccctaatcccccgcttccaacccccacccctctcttctcttcacaccactgccaggacgccttttttcccttatgaatctgaccatgcctattctttgcttgaaacccaccagtgggtctctctcaccaagaagataaagcctgtattctagagtgtagcatgaaacactctcatgatctggccccagtctcactttctcttcctggcctcactccagcccagggcttgtccacactggcttcacattagcatcaccaggggataatacaatgccagcatctgggccttactccagtcaatcacattagagtccctgggattaggccctgggcagaagtggaatttacaagcttcccgggtgcttcgaatgcactgccagggttaagcatcgctgcttccccccattctgagcagcttgcttgggcctttatgcttttgtgtgtaggtcctgctgtgttggacagtttgctctgctttttctacctgcgatgtctccttatctttggagacacagctgaagtttcccacctttatggaagtcttccctgggaccccctcgaaggggctcctgttgcccatgacatttcctgctatgacaatgtaatcatttgcttgcatggctagattcctgctagaaagggacccccttgggaggcccaatgtccattcatctttggatcctcacactgttgtggttgtctaagtacagcgtctacacacacttacatgtttttttgataaatgaaaatatcattggagatttgtcctccatcatgactctaactggattctcagctcttggcttatatttctgctttagagtttattcattctgccttgatcacagtacattgtctacatgatcttcctccaccacctgtcctcactctgggagcttatttcctaccactttttacctcaagcactcactcctgctccattggcctcctccctgttccttgacctccctgttcctgccccagggccttcgtctgtgctgttccttctgctgtcatgcccttcctccacatgtccacatgactcactctctccttcctttacatggcacctcacagaaaggcttctctgatcacattcgtcacactctgcctcttacttggtgtctttctttttcagagcccttctcatctcctgatatatggaagatttatttgtttattcttttcttcatctgcttccctccatagcatgtaagctgcatggggcagggacttgattgtgtttgatattgcatctccagtgcctagaatagtgcctggcatgtacaaagtgcctggatgctataaatacttcttcaatacacgaatgaatgaagatgatttgctttctagtaagccagtattttctttctttccttttcttttctttctttctctttctttctttctctctctttctttttctttctttcttttctttctttcttgctttctctctctctccctctctctttctgacagggtcttactctggggcctaggctggagtgcagtggcatgatcatggctccctgcagcctcaatctcccatattcaggtgatcctcccacctcagcctcccaggtatccaggacaacaggtgtgcaccaccacacctggcatttttttatttttatttttagtaaagatgggttttgccatgtagcccaggttggtcttgaactcctggactcaagctatccacctgcctctgcctcccaaagtgttgggattacaggcatgagccactgaccctagtcaagccaatatttttcaaactgtgagtttgaaattggtcatcaaatcaacttaatggatcacaaccaacattttaaaaaataaaatacactagaactgaagatatcacaattccttgaacatagtaagggcaagtattattctgtaaaacttatcttggtcaatatacagtatctagcaatcaggtggcaagacaaaatgtattcctcattggggtttattgtacacatttttggaaaagcattgtgttaggccagagattggcaaacgtttcctgtaaagagtccagtggtaaatattttaggctttgtaggacataaaaactattgaactctgattttgtagtgtgaaagtagccacagacattatgtgcacaaataagcagggccatgttataataaaactttattaacaaaatcaggttgtggggctagatttggcctgtgggtggtagtttgccaagccctgcgctagactgttgtctagcctgtgactatgtttcatatgtgtaaattccctttatacaggagctatgtctttttcatctctgaatcttaaccatgagtgtgtcatcccagcatctaacccattgattaaatataacaaatgttcatgaaatgtttgccaatatattcaatgaacatttattgactccttaactccaaacagcttggcaccaaatccatcagtatttgttgaatgaatgtaagagccatgtcttagtctgtctgggctgccataacaaaatatcttagactggataattcagaaatttattgctgacagctctgcaggctgggaagtccaagatctaggtgtcagcagatcagtgtctgatgagggctttatagatggtgacttttgctgcattctcacacagcggaaggggcaagggagctccctcacacctcctacgtaagggcactgatcctattcacgtgggcagagtcctcatgacttaatcacttcccagaggaaccacctcttaatactatcacattgggtattaggttccaacatatgaacctaataatatgtttaggaagacaccaacattcagaccatggcaagccattagtctcaaattctcaaaagcctttgcccctcctccaacccttctgaagatcaggactcagagctcaaaggtgtccttgccccagccgcttgggtcacttgctgccaggggccagaaggggtggtgggaaggtgatgggaacaacagggtttgatggactgtttggggaactgtctaattatcctgcttatcagtgctggttccttttcttagctctttcccttaataaatgaaaactccttctgttgttattgagctcccgggtcactgattcttttgagtcatataaaccacatgtttatagagttacagtgtgaccgtgaaattgaatggaggggaagggaggcaccagagaagtgtcagccttgaaaggcaacactttctcttcccaggcttctgctcattgtgtagggcaaaggacagggctttccgctgtccagggccctggcctaggcggggaggggagctgaggtcactgggtacagcttgtgcgtccacagagcttacagcctggttggggagggagatggccaggctcagagttgaagatgacctagatcatgcgtcaacaaactatggcctgagggccaaagccagcgcaccacccgtttttgtacagcccatgggttaagaagagttttcaaaattttaaacagcagtctccccttatccatggtttcaccttctgtggtttcagttacttgcagtcaaccatggcccaaaaataggtgagtactatacagcaggacatattgagagggagagaccacattcacatgacttctgtgacagtagattgctataattgtctgattttattattatttattattatttctctcttactgtgcctaaatttataaattaaactatatcacagttgtgtatgtataggaaaacccagtaaatgtagggtttggtactgttcatggtttcaggcttccaccgggagtcttggaatgtatcctttgccaataagggggagctactgtagtcgggaaaaaaaatcaaagaacaatattattcgaagtgggaacatgatatgaaattcaaatttcagtgtccatgagtagagttccagtggaagatagcactgcccattcatttacgtattgtctgtggttgctttcccactacaagagctgactgagtagcttcagcagagaccatgtgccctgcaaagcctcaaataggtagcatctggctctgtgcagaaaactttgatgacccttgcctagatcatggtctagcagcattgatatcacctgggagcttgttagaaattcagaaccccaggcaggcgggactgcagatctagtgaatgagagcctgcattttaacaagatcccctgggtgatctgtgtgcacagtcaggcgctagaggaagcaaatcaacatctcttaagtatctacaattttttaagagtgcgttacctcaatcagtctttaggttaatcccttttccactagggacatttactggccctgttttgtttttattttttgagactgagtctcgctctgccactcaggctggagtgcagtggtgcaatctcggctcactgcaacctctgcctcccaggttcaaataattcttgtgcttcagcttcctgagcagctgagactacaggcgcccaccaccacgcccagctaatttttatgtttttagcagagacgggtttcgccatgttggccaggctggtctcgaactcctgacctcaggtgatcggcccgccttggcatcccaaagtgctgggattatagtaggcatgagccgtagctcccggccaactggggctattttacaggtgagaaaaacaaagatcgcacgtcaagtgctcgcccaaggttatataattaggaattggctgagtcagatttaaactcttaggtcctttgtacatcctgtggccttaaccattaagctcaatggtcccctatacagagagggtaaggccaaattcagtgtcttctgtctgaagctggaggcactaaactggctccctaagataccctaagtgggtggctgttttatttgacgtatacagtgtttcaaaagatttttaaattagttgccaatatttaaaaataaggagtctggatattggagaccccagataattgattctttttttctttttctttttcttttcttttctttctttctttcttttttttttttttttttttttgagacagagtctcactctgtggcccaggttggagtgcggtggtgtgatgacagctcactgcaacctccgcttcctgaagaattgaagcaattcttctgccttggtctcccaagtagctgggactacaggcgtgcaccaccaaacccggataatttttatatttttagtagagatgggttttcaccatgttggccaggctggtcttgaactcctgaccttgtgatccacccatctcggcctcccaaaatgctgggattataggcgtgagctaccacacccggcctgagaattgattgttataaaagaatctggaaatcaggcttccctggctggggctaagttgtgacttctcttgcaggatggcctcgaactcccagcctgggcttctgactcatggtaatgcctggtcccttgggcatctgagtttgcatcccttggtcaaaaccagtggttatgcagaacagcctgcaaatcacctgtgcattttgttaaaatgtagattcagagttggcaggtctggaaacaggtctgcattctccctttttttttttttgagaccgggtctcactctgttgcccaggctggagtgcagtggtgtgatcacagctcactgcagcctcgacttcccaggctctagtgatccccctacctcagcctcccaagtagctgggaccacaggcacatgctaccacaaccagctaatttttatttatttatttatttaatttttgtagagacgggctgggggtgggggtgggtctcaccatgctgcttaggttggtcttgaactcctagactcaagtgattctcccatctcagcctcctgaaaacttctgggattacaggtgtgagccactgtgcccagcctatgttctgcatttttaaggggctcccaggtgatacggatgctgccagtacttccatagggcacactgagcagcaaggctaccgaagagctcaggaccgtctgacttcagggcccattgcccagatcatctgaatcggtgcccttggctgctgatccattatctgttagagtggccaggggcctctaggtccttctcttcagctgttagcagcctcctccatcgacctgctgagttgtatagctaccactcttttctaggagtgtcatgacgtgaacaaggctgagcagcattcactggcccatcacagtgcctcctttgtcttccagcttcacccctggaggacagagctattggtatggaggtctcctgggggtgaagaccaagagtcaagcaagagatcagggtctgccgctagtgtcctattgatctggaggcttaatggaggcagatgtttgtattttagaaagctgcttcccctacccccaacacatggacagacacacaccccaaaatgtaacaaacccattgtctgcatcatctgtggtcttcctggaaaacaagcctgccatggccacctgtcggcagtgatgccaactgctccccggtacagctatttccaagattccagagatgtggctggtttcacttccaggaagcttgctggaagactgccctgtgccccacgcctcagtagggcagggggcctcccctggttttaggatcatgcttctcctgcctgctgatggtaagaatgggctgtgcctgagcgttttggctagagaagccctcagcagacatataggctgtgttccaaaaggcctggcagaactctctggagtcttacctcccctggcatggatgccagaatcagtgggaagaacgtgtgcgtgtgatatgcagccctgtgcaaatcatttctcctctttgatctctgcttatctcatctgtaaaatgagtatcattgaaacggtcctcacagggataacaaaaattacatcctgggtcctgtgcagaaatatagttctattaagcactaatcaggccacactttggcccacttccttgtaactgagagtcaggtagcactagatactgaccatctgcatcctcattgttcctatacctaggatttctaaccttagaatcataggtttttgtttacgaattgatttatatccccattgttcctatagctacgatcagtgaccatggactcataaggcttttgtttaagaattgcctaagatgttcttcagatcctgaattccagcaggaaagctaatgccaaccagtttgaaaacaaccacagaggaatcgaatcagcacgagaatgcagtttcttcatttccctgtcccatgactttactctgcactctttgaccaatcaataatcctggaccttggcccacttcaaaccccttgaaatctctagctccaactccctggaggggtggatttgaggtttcctcctgtttccttgtttggctgccgtatgattattaaactctttctttgctgcaatccctgttgccttggtttattgacttactgtgcatcgggcaaacaaacctattatgatgacatcatgacgcaatatccacctcaaaggactgctgggagcctcaaaaatttacaaatttgtgaattgtatgtgactgtctgatgccggggagcagcaaggagcttttggtgattggagtgcggtaaattataatgttccccaccccaccgggtgatgtgtgccccacttctgtctgagggtctcttaaggggaagaattctctggcctttgttagatgcagtgtcaggatggctcaacagacatgaccaggaaaacagagaaaagaaaaaaggaaatcttattgcttttcaatgtctgtcagttaaaaaaaattgatattctttgtttttcatggaggggtcctctgcatcagtgctcataagaacagacaatttatttcttccaaatgagtctgttcctgggcctctgtccctcttgacaaaatggggcttatagatggtgtacactgtctttaaaacacagtgccagagggtggtattctttctttctttttgtttaaatcattcttttgaaatgaatgttcttggttttggcttcaggcctggtgtgagatcagttgaccaaaacacaagagcagttcatatgcaaaaggtcagtgctggtctcaaaggtactgacatgtttcttgggtggggccttgtgaaattctttataaataaactctctaattaagttggctccttgccttgtactgggaagagatgattacaccagggtgttcctgagggtccctggcagcaagcagaacagggctgtcaatctcagtccaaattctgcttcaccacttacctgtgaccttgggcagaatgactcttggcacctctataaaacagggatcagaaatacctctgaaatacctctgaaggttagaggagatgcacaaggcactcatcgtggtgtacgggcacttgggaattgttactatcctccttctctttccttattcatccatgtaatctgctctgagctatcccagagaagcagaggcccagggaagttaagaaatttgctgaaggtcacaatgctggcaaacagttgagccaagctcagaaccccagcatcagttggttttccccagcgccagtctaagcccaaagcccatactctcttttgcttatctccccatctcctatttctatgaagctttagactttctaatgcacttttattcactagctctcccaagtgattgggtgaggaaaatcatgaaataagggaaaattgcatttacaggtttaagtgactggcactggtggttactgctggccccagggagtgtgaggctagcaggatgacccagatttcccaaaccaggccagggctctttccagtgaaccaaggatgatgtgaagatgcaggaggtggcagaggaagatctcaggtagaggtcttagctttaagttcttgtaagaaaaatgacttcatgatctagatggtcctgccttcaacaggtgaacattgggttacacagagaagcaggatgactgtttcagttagctctgcttacgcctagaatcacagcattttagctttcaaaggcaggaagcaaatttaaggactctttacaagatgggcatgtgtgtcttttatatgtatatatacgtatatagacatatatacgtatatatacgtatatatgtgtatgtatacatatatgtgtatatacgtatatgtgtatgtatacatatatgtgtatatacgtatatatgtatatatgtatgtatacgtatatatgtatgtatgtatacgtatatatgtatgtatgtatatatgtatatgtatatatgtgtatatgtatatatgtatacatgtatacatgtatatatgtatatatgtatacatgtatatgtatatatgtatatgtatgtatatacatatacacatatacacacaaacacatgcacacacatgcaaatatacacatgcagttgattctcattattaatgctagttatgccttataaagttgcagtgaacactgaataagtgaatactgacccattgctcctaggagaaatacagagttaagttcctttaagcctctggtcacaatattttcatccagtgattaatatataaacttgtgttatgtgtgtttctgctgaaagacattttaatatatattgttgattcattgacattaaactcaatgccaatggtactgtataactcatgcctaaatgaaacttatctaacacatctatttttttccataaagaatatcacttaggaagactagacagcacttcagcactacacttcgagggcattttaaacagtgaaatcatcaacaaaaagcacaaaaatgcataagtgtggcaccaaatagactgcaagaaggacacttgtttacggtttgagagctgaaaccaggagacagagtgttatcttatttgactcaaatttttcaccactctgagcaggtccgtgaatggccacaaaactgctgcgagatttcattttggggctacaaaggaatttttgcaagtagatgaattggcaaacatggagtctgtgaatgatgaggatggactgtgtatgttgcatttgtggagaggacaacttcattgcagaggatgtgtaaagggagcacagtgcctaaagtcttcattaaggtgtaggggactgatgtatcccctcccgagggcccactgtgctcaagagaagcagagaatacgccgggagcggtggctcacgcctgtaatcccagcactttgggaggctgaggcaggtggatcacgaggtcaggagattaagaccattctggccaacatggtgaaaccccatctctactaaaaatacaaaaattagctgggcatggtggcctgcgtctgtagtcccagctactcaggaggctgaggcaggagaatcgcttgaacctgggaggcagaggttgcagtgagccgagatcacaccactgcactccagcctgggtgacagagcaaagctcttatctcaaaaaaaaaaaaaaaaaaaaagagagagagaagcagagaataaaggaggccagtggccatcaaaagggagtggcaggtaggtgagagaggacatagggagggaggtgggattgagagggagggcagtgggtgttgggggggagggtccctcacggtttagctgggtcccagaactccctccccctgaacacctcgtgggtgggtgcctcttctctgctcacttttggctggacttctgctgatctgtgaaacacagagagactctcctctctggctgtctcccagttgcggggaaccttttgatttcttaactattcccctgggatccattcctctatttgctcattttctaatactccctcttcatcaccgtgttactgggccactgactcccactccaaaggccgaccaggcccggaaagctcataaagtgagtcagcctaagagaagggatccgagtccaggtcacttggagctgatgacggcagcgaacctggctaagccagcgtgtgcaagatgctggcgctgctggaaacatcgcctggaggagcggccctctcatcacccggaacagacaggggtgtctgcagaggtttcccaacctgtcatcattactctagggtcttcttagaaggacaacaaaccctgtacctgcatggcggagtgttaggatatctggtaccatgtcactcccctgagctcagccagactgcctgagggttgtgccccactccaccatttactgcttgtgcctcagtttcctgatctgtaaaatggaagttctaatagtatccacctcatagggttgttatgaggactgcactacatatatacatatagcactgagaacagtgcctgcacagagtaagctctacagaacactggcttttattattgtgattattattgctcgtattattactactcttctcatctctaaagaatggaatggggctgaacgatttcaaaggcctttctttcccttcctgttctgttactggagatgctcccttgctgtgtggccttgggcaaggcccttgtcctctctgggccgcaagttcttatcttctaagtgaggtgctgggagtcaagccctgagagcctgaatctatgaaataaggataagatgactcctagagtggggttcatttgtgactgcagcctctcctggggatgctgaatttccttattttaagaatttactcagaatttaatccaattcctctcccctttttgtctattgtaactgcttatttcatctcagctgagataaatggttaagtaatcaacataacagggtatatttgtagtgtgtttttaaagctcccattcactgaaccaaccaccttcctaagcctggattaatttattctatcatcattacaaccctgggagggagattattgtccctgtgttagagatgaggaaattgaagcacagagaaaagttaagcaacttgcccaaggacacacaaacagtaaatagtaaatccagatttaaaccaggaaccttgactccagattctgtaagctttaccctgacactataccagcggttggccttgagcttaatttctaattctacgatggaaacgctgaggtgggaggcaggtctttactccagaccagactgatgactggctgaaccagggaagaggcaaaagcacctctccataagacatgctcaccagtacatgccagtttacccttgccagtaactcagaagttactgcctctttccatggcattgacagatccaccccttttctagaaatttctgaatagcccgcctcttaatttgcatgtaattaaaatgggtataaatatgactgaaacactgccccgagctcctattctcaacacactgcctgtggggtagccctgctctgcaggaggagtcacggagctgtaacactgctgactcaataaagctgttttctcctaccactggtttgctctcttgctcttgaattctttcccgaacaaagccaagaaccttcccaggctaagtcccagttgtggggcttgcctgctctgcatcaacatgatattgagcaattccttccaatggactgctcataacattggttaataccacagaatctcatcattggaggataatgtaagggtcacctccatggtgtcttaattgggctggtcaggcgactaatgagaagctgaaggaagttatggacccctttcccccaaaatgctcatgtcacatccacacataaacacacatgcaagtttgtctctatttcagggggtgcaaatatctcaggctaagaacctcacataatacttaatctcttgaaactctcaataagtttcctaactctctcatctttgctccaactgtccagtgatgagaacctcttacctaagggggcagtccagtaagatgtgcctctgattgttagaaagttgctctttccacaggactgataacactgattgggtcccaactatgcccactagatgttatgtagaatcggtctaatctatcttcccatgataatcctccatgtttctgaagatgttgttggtcacactctctctagttcttctggggtatatgcctcatccatccactacttggttcattcttccatacattaatttgtcactatccctttcaaacacccaaaattggtgcagcccagaacaccagaatcttctggctgtggactggctagctaggtgcagggctcttgtttttgttctgggtatcatctttccattcatagatcctaagagtgaattacatttttaaaatcttattttgaaatatagcacaactatgaagaagggcaaaaacaaaaaacaacaactcaatgaactatcacaaagcaaatacccacataaccaccccctaaatcaagaactagaactttgcccacttctgcctcatctccatgactatcccttccgtcctctccgaagataacttctattctgacttttatggtgataatctcttgcttttcttagaagttctatcacctaaatatgtatatgagttaatgctatagttaagttttcctggtttttaaattttatataaatggaactatagaaataggcaatcttttgtttctgacttatttcactaaatggtgtgtttgtgagattcattcaagttgctatatgtagttgtagttcattaatttttattgctgaaaatattccatttatatgaatatactacaattgatttatctattctattaaatggacatatgaatttccagcaattataaacaaatctagcataatcatgtgctttggtcacacatgcatgtatttaggtcaggtatacctaaaataactcctgtgcgatcagcttagtagacaatatcaagctatattccgaagtggttgtacaaatttatgcttttacaaaaaatatgtactttctgtgtgtctgttccaactgttccatgttctcaccaacacttagcattattaatctttttaattttggctattctcgtggctataaagtagcaactcattgtggtttcaatttgcatttccctgatgactaataaagttgagcctattttcatctatttatttggcatttgttgattagagcttttggcaacccagtcctcatctgagtcatactaaacttgtagccaagtgaaataaattatgtgacatatgatgctatttaatcatatctcccctactgacttaggttggattttgggtgcccagaacaggtctgaacattcttaataatgacgggccatatttctggtgtgcccacttgtttcaggcactgagctatgtgcttgacatatataatgtctcttaatcctcacaaccagcttacgaagctcatacaattattactatgttcattttacatgagaagaaactaaagtggacgaggcaacttatctaaggtctcacaactattaggtggtgtgacctagattcaaataaacacccttagccaccgtaataacaatctgcttccaaagacggagacatatggctgcatttaaaaaaaaaaacttaaaaattgctaaaaactgaataataaggcaaacatgtcattgtcaaaaggagaaaatagttccaaagtatgacaaagcattaatggttttcgaatgtgagatgttcttacaaattaataaaaggacaaccatctcaatagaaaatggcaaaagttttctggggttagataaatctgggaatttctacttacttttccgttcttgtaccccaacaatgtatatgaccaaatttatgactctaagaagttctgcgctaaaagcttactttaatgcagagttttccaaacctatatgacaaaaatagattttggcatcctgagtaattacaattcttcagaacatgctttgaaacatgttgaactctattatcaccacggcttcctctggtttctagtctggtaaaatctccaaaaaaggaaatgaagttagttttgtgcaatgtttctcaaccttgatactccagtagtcccttcttatctgtggttttggttacccacggtcaactgcggtccagatacattaaatggaaaattccagaaataaacaattcctaggttttgaagtgcacaccatcctgagtagcgtgatgaaatcttgcaccacccagctccattctgcccaggacgtgaatcatcactgcgtccagcacgtccatgctgtatatgccacccacccgttagccacttaggagccatctcagttactggatccattatcacggaatgttcaagtaagtgttattctacttcatagtggcccccaaagttcaagggcactgtgcctaatttataaattaaactttatcataggtatgtagaggaataatgattcagaactatcagtggtttcaggaatccactgggggtcttggaatgtatccccagcagacaagtgggatcgactgtattgacattttggggcagtacaattttttgtcgtgggaagctgtcttatgtactgtggatgtctagcagcatccctggcttctacctggtaaatatcagtactaccccctcactgtccccaggttataacaaataaaattgcctccagacacatccaaatgcctcctgcccgggggcagatcattttcctcccaaccacttgtctaacctgactgacttctaacgaacttatggtatccccatgaatacggaccactgtctaagcactcccaaaatggcacagagtttcaccatattttgatttctgtttctcatgatgtccactatttttttgttttaatacaagggggtaattgttccatctcttgtcttctagtcttttttattttttaggatttcttaaatctccaggcacacccaatcacatgcagttcccctgatgccaggtttcctcttactagttgaattttctcctttcctgggcatgctcttaatcaccagtgccaacaaaggccatgcacttttctttctaaatcaagcctcaattctcctaggatgccttttccaactaggtagaattaagttcttttctctaagcctcataccctctgcacagccttctaccaggcccccaacaacacattatgcatatttacacgactatctctccaattccttgaggacagggactgggtcctattgattttccaattctcagcatagagtaggcaccacaagtataaaagaacaaaggagtgaagtataatttgggataggccagcaattgcatccatgggggcctgggtagatttcaagcaacactgagctcattgacagcctccttaccagctttcttctaggaacgttctctttgcttgtctccaggaggacaatcttcactcccaagagaaggtaaacgtaccacaggtaccagctttgtttttctctctctcagctatgaatatgacatcctttgcttcatcaacttggtcgagactgttactgcaagttttctcattccaaacataaggagaaaagtccttttcccttgatctcagcatttttgcaaacctcagtttattctcgtctgtgtcattttttttttttttaatccttggagtgcaccctcctttccatgttttgggaggcccttctggacctgagtttctcatctctttatttcctttttatgtcctgttggggattattttaagctttaagcacagagtttaattcttgggaatgctttgactttaccagagctgtccaagatagtggaaatgggtggagagaaagatacaggtcagagaaacattaacaaggggcaattgacaagacttggagaccatttggacatggaggagggggagatgactcccaggtttctgttttgaggcaactaaatgactggtggttcctgctgcagagatggaggtcacaggaggaagcagaggaggaggagaaggagggaggtgagggtgtctgggaagatgctgagcctggtctgggatgtttaggctctgaggtttccatgggagacaaagtagagatgtagaggacataactggatataagagcctgatgctctgggaaggaaaaaggtgactcgggagtctgttggcatgcagatggcagctgaagctgaggtagctgacaagagcactcagggatcgtgtgcagatggaatagccacggttagggatgatgcaggaagaaaagttcttgaaggagaacaagaaggagtggcaagagacagagaggaggaaagccaggagagaagcatgcaccagaggccactataaggagagtttgggacagaaggatggccagccactgtaaatgatagagagaggtggattccaataaggacagaaaagtgcctgctgaattagcaacagacgatcattggagaccactgagaggacagctttagtggagtggagggggctggagccatatgcaaggatggaagaggcagtgggagacaagggaattggggggcagacataggatgatggttaaagaggggttcgttcattcatccacccaagcaagaagtggggcagggggcctcctgtgtaccgggtgccactcagggctctgggatacagcagtggaaaaccaggcagaacttcctgccctcaaggtgtgtactttctagagagatatactctgaagggaggactctttttaaaagatagttattagaattatcatttgactgatgaggaaaccaagagaagttagatggtaactcacccaagtttatgaagatgtccaagctatgggtcatgccctgatctgcctgacccattccttttgttttgatttttcttttcttttttttttttggactgaatttcactcttgttgcccaggctggagtgcaatggcgtgatctcggctaaccgcaacctccacctcccaggttccagcgattctcctgccgcagctttccaagtagctggaattacaggcatgcgcaaccacgcctggctaatttttgtatttttagtagagacggggtttctccaggttggtcaggctggtctctaactccgaacctcaggtgatccaccctctttggcctcccaaagttctgggattataggcgtgagccaccacgcccagctgacccattcctttttaggctgcctgaagggaatggagtttagccatacagaaggtataacagggtagggaaaactatagatgtgaggtgaagaattattcacgtctgggtgggcctactcaaagaaaggtgtctacttggcctcacattgtttaactccagctgtactttatctaggacccactatgttgggcattgtgtctgggctcaagtcccctccaatgtgagtggcaggtactgagacccacatgttcccacttgtttctgaaccagaggcttgagaggcaaactgtgggagacccccagtgccccctttcctgtgggactctgatgcacatggtttgactggtgttaaactatctctacatcccattgttgaggccaagtacattgatccaagcaaggttccatgggattagatacagaggtgctggacaaaaagagggtctttatcctttggggatggtgagcttagggaccaggttgggtggctcacagccattttgactgtctgaagaaaatgccaagtagagatgaacagagccaagagataaagagggagatcaagctctatttcatttgaactcctggatccagctctgctgatcttggtagattcctaccaagaactatctcagacatcctaatatcttgaacattttgacacttgcaactgaaggagtctgaccaatatagtttgtcaggatgttatttgtgactgtgtgagatatattatattattgacttttgcagttaactgactctgggggcttcttccatgaagccagatgtgtttgccattttctaggtgtcagcagccctacagtgattgatatggtttgcatttgggtccccacccaaatctcatgtcaaactgtaatcccccatgttggaagaggggcctggtgggaggtgattggatcatgggggcagattttctccttgctgttcttgtaatagtgagtgagttctcacgagatctggttgtttaaaagtgtgtagcactttggccaggtgtggtggctcacgcctataatcccaacactgtgggaggccatgacgggtggatcacttgaggtcaggagtttgagaccagcctggccaacatggtgaaacccagtctttactaaaaatacaaaaattagccaggtattatggcacacacctgcagtcccacctacttgggaggctgaggcatgataatcactttaacctgggaggtggaggctgtagtgagccgagatcacgctactgcacaccagcctgggtgacagagcgaggctctgtctcaaaaacaaaataaagtgtgtagcacctcccctttctctctcttcctcctgctccaggcatgtaagacaggcctgcttccctttcgccttctgacacagttgaaagtttcctgaggcctccccagccatgcttcccatacagcctgtggagccacagccattaaacctcttttctttaaaattacccagttccaggtatttctttagagcagcgtgagaatggactaataaagagatgagtaagacatgggcttacaacatggctgtggagatgatgacagcaaccccttacaaaataattacgctcaataaaatgctctacatctctttctcttcagtcgcaatcatagagaatgattagttagcaattccaggtaggatttggcaaggatggactgaactggagagatgttctgtgcaccaggagctctgaggaaggtgggctgggaggggaaggagatgtactatggattctttctaacactctgttctgggtgcctgtgctaaggggttgatgggtgacagagggagagaggaacaggtagtctggggaatctctgggtgtgtccactgtgagtggaagggctgtttctcatacctttcccattccagcgtgggcatgtcccagcttgactaccaccgggaagtgtggggctgtgacctgaaagagacaagaagaagtcactcttaacatctcagagcattgccaccaaggctctgggtgctgcttgttccatagaaagatccattcatttcatatggtcgggaatccccacaagaatgcttcgacagatggtcacccagccatggcccaaacaccctcaatgtcagtgcttttggcttccaaaggaagctctgagctcttaagaccagcttgtctggggcacccatcaatctgcagagacaatggagtgggacaaaccaactggtttccaatcttggctttaccgctgtgcaacttcaggcaagttattgcattgacccatgcctcagtttcttcatttgtcaaatgaagacgataataatagtatcccacggggttgctgtgaggattgagttattacatgtgtggcactcagtgaatggaagcttaattattcctggcatactcctgtcttacattattctctttttttttttttttttttttttttttttgggacaagtcttgctcttgttgcccaggctggagtgcaatggcacgatctcagctcactgcaacctttgcctccagggttcaagtgattctcctgcctcagcctcccaagtagctgggattacagatgcctgccaccatgcctggctaatttttgtatttctagtagagatggggtttcaccatgttggccaggctggtcttgaactcctgacctcaggggatccgcctgcctctgcctcctgaagtgctggggttacaggtgtgagccaccgcgcctggcccattattctttcaaataacacttcaaccacctgaaaactttcactacttcccttaagcctccccaggccaccatacgaggctgcttaataatagcggccatgtctgcctctggcacaagcgtttatcgactgtaccacataggctccgtgctgagcgactgctctgcgtcacctcccttaggaagccacacttgaggacagcagccttgctgggttggttccctgctgcacccccagctcctagaacacggcctgatccagggaaggtgctcgatactgaatctgtccttcaatcaggcccctcagcaagacctaggaggcatgcatgcttctccctctgacacaagtgagacagttgggctggaaagactgtatacttccccacacacaccatcacttaaccagggagctaggaagccaggactcaggcctgagctttgctttccccctttcatgttgttcatgtgttttttgagggtgttttcttgatttctagaagaacattttgcattgcgtgagggcaaaggttatccctcctagttatgtactaataacataacttccttccatgtggaccattcccaactgggggccatcctgaccccttctcctcggctgtccatggacagcactgtctgtcctcttacactgtgggcaccgaaggaacgcagccttgccctcttgatgtctcttgcctggtctgtcctgtagtagctgctgagcctctgcagaaggccgcctgtgcatcacaaagccattctgtggccctcatctcattttacccccacactggccttagaaggcaaccagggaaagtattttaatcaccattttacagataagaaaatcgagactcaagtgagttgctgggaaggggtggagctgggacttgaacttgggtctgtcagactcccagcttgagttgaacagttcccttttagtctagcacaagagtggcctgcagtagactttaaataatattttttttgagacagagtctcactctttcgctcaggctgaagtgcagtggcacgatcttggcccactgtaatctctgcctcctgggttcaagcgattctcctgcctcagcctcccaaatagcaggaattacaggcatgtgccaccatgcctggctaatttttgtatttttagtagagacggggtttcgctatgttggtcaggctgattttgaactcctgacctcaggtgatccgcctgcctcagcctcccaaagtgctaggattccagccccggaaaccactgcgcccagccatagttttttttttccttgatttcaggctaaaatttaccataccctggtgtctatggtgaatacatacatgttaaaaaaacagcaacatttgattttgattccaaaagcaataagtactcactataaaaactttgcaaaatatgataagattaattgaaagaacctcatcagttaccttattgattgatatatatatcaattaccttaagtataaagacgtcaataaaaatcatcctcagactgctaacagttttggtttattatctgctgctcttttaaaaaaaatctgtattgaggttttcccttgatttgttctgtttttacaaaattgggagtatagtggatatccagtcttggttcttgctctttccacttaatattatgtaatgagaatactcctggtggttattacttgttaacttaataataattatgaaatatttcacatatggaaaaagccttaaagagcaatattacagacatcagcttgcttaagaaataaaacactgcttagacagctgaagcccctgatgtactttttttttttttttgaggcagagtctcgctttgtcgctcaggctggagtgcagtggtgcgatctcggctcagtgcaagctccgcctcccgggttcacaccattctcctgcctcagcctcccgagtagctgggactacaggtgcccgccaccatgcccggctaattttttgtatttttagtacagatggggtttcactgtgttagccaggatggtctcgatctcctgacctcgtgatccgcccgcctcagcctcccaaagtgctgggattacaggtgtgagccactgcgccggaagtcaagtttatgtgtcttgactctccatcaagcactctctccatcaaggcacacttttctgggaatcatatgcatatctggggtgtaataaatgctccccaccccccatgatagtgatcaataaaataatatcaaatcaattgcgtgggcacgactgaatgagaactatgtggctagttatgtgtcttgtgctggttggggcacaccaaaggttgagacaagatttctgccctcagaggatttattatctgcttggacccatgggctgtacaatgaaagagcagagtgaggcagcatggcaggaagctgtggggtacgtcgcggtcatgtgcaagtctccagagcagagcccaacatttttggcaccagggaccagttttgtggaagagaatttttacacgaactagagggggatgaggggatggttttaggatgattccagagcattgcatttattgtgcattttatttctattattattaccttgtaatacatgatgaaataattacacaactcaccataatgtaggattagtgggagccctgagcttgttttcttgcaactagacagtcccatctgggggtgatgggagacagtgacagatcatcaggcattagatttacataacgagagggcaacctacattcctcgaatgcgcaattcacgacagggttagtactcctatgagaatctaatgctgcctctgatctgacaggagatggggctcaggcggtcgtgcgagtgatgcagagtggctgtaaatacagatgaagcctcactcacttacccacggctcaccttctgctgtgcagctctgtttctaacaggccatggacctgtactggtctgtggcccagaggtgggggacccctgctccagaggaaatgaggctctgaccagggttctgaaggatgagtaggttgtgggtggatggatagaaggcacagagttcccccaagggtgaatggtgcagaccaccacggtcttcccgtggggcatgtttagattcttcatgagctctaataaacaaagacccataggaaggaaggatttattttatgcaacttaatatgattttttttttttgagacagagtcttgctctgtctgccaggctggagtgcagtggcacaatctcggctcactgcaacctctgtctcctgggctcaagcaattctcctgcctcagacttccgagtagctggtattacaggctgtgccaccatgcctggctaatttttgtattttcagtagagaccgggtttcactatgttggccaggctggtcccgaactcctgacctcaggtaatccacccacctcggcctgccaaagttctgggataacaggcgtgagccacccctcccggccacttaatatgatttgatctgcaataaatctattttgcaggtgattgctgaacagaattgtatatttgaacggcatgtccttctccagggttcttaaatgaaattggaggaatgtgttcattgctagaaattgtggagtaggtgctgtatctgtatttagagaacacagaaagtcaatctagcaaaatctgagaatgtttaagtaagatatttcacagaaaacatttcagaattcatccaaagcaatggattttcctgatactaggggaaattttcctttgcctttttttttctttctttttttttttctgagatggagtcttgctctgtcgcccaggctggagtgcagtggtgcgatctcagctcactgcaagctctgcctcctgggttcacgccattctcctgcctcagcctccggagtagctgggactacaggcgcccgccaccacgcccggctaatattttgtatttttagtagagacggggtttcaccgtgttagccagaatggtctggatctcctgacctcgtgatccacccgccttggcctcccaaagtgctgggattacaggcgtgagccactgcgcccagcctcctttgccattttttactttgacttgtgggaaacagcaatctttttagaaccacgtatgggctggcaagactccgggctagtgctggggacacagaagaggtaatttggggccagattattgggggcctttgaaaccaaagaggggagttcaggttgcttggatggacagtggggaagcaggatagttctggaaccggggagcgacctgccagctgtgggcaggatggatttgtgctagtggtgactgaagggccaggggccagtttggaattcattctaaagacagtaaatgccactggttgggcctggactgggaagaaatggtagagggagtgggagcactcccagagcttttcttttcttttctttttttttttttgtgacacttctttattgaaataatagtattaaaatgaccagagaaattcaagacaaaaattgtctacaatctcattgtctaaccaaatcagtgtttgcattggtccacattaccttataatttttatatgtccaataaaacccccaggatactttacaacaatattagaggtagaattttgcatctatcttctcacttaatattataccataagtgttttcttatttttgctacagatgtttttattttcttctatctttccccactccccttctccagaccaggtaactaatctcacctccccagtgtgtctggggtgtattcctgcccatccctcaccacgtgcaatctttgcaaacacgtatgcacggatatggctgaggctgatgtttgtatttttgaaaatagctcttatctcttaacgtcacactgtatacacccctcctcccatgtcaataaagatagttctatcccgatagttttttgttttgttttgttttgtttgtttgtttgtttgtttttggagacagagtcttgctctgttgccaggctggagtgtagtgacacgatctcagctcactgcaacctccaactccctggttcaagcgattctcctgcctcagcctcctgagtagctgggattacaggcacgagccaccatgcccagctaatttttgtatttttagtagagacggggtttcaccatgttggccaggatggtcttcatctcctgaccttgtgatccgcttgcctcggcctcccaaagtgctgagattacaggcgtcagctaccgcgcccagccaatcctgatagttttaataatagctgcaccgtctacacatgtacacgtgcactggtttcctattaatagacatttgtgttattcattctctctctgctactataaacgagacttcattaaacatctttgtacacatgtccttatgagctagtgttttaattcctccaggccagtccaggagattttcaaagggagaaccagcagaatttggagacattcttttttttttttttgagatggagtctcgctctgtcgcccaggcttctatttctaaagtcagttgttagagctcaagaaatgaaaccggatgccatggcattgcatacggggtgaatcagccaccatattacctccaggctaaaagtgactgtatttattgtcatgtaagaagggccaggaacgggaccaggcactttatggatggtagcatcctttccctcccccatgttatagataacaaaacacagcgctggccgggcgcggtggctcatgcctgtaatcccagcactttggcaggccaaggcgggcggatcacaaggtcaggagatggagaccatcctggctaacatggtgaaatcccatctctactaaaaatacaaaaaaaaaaaaaaatagccaggtatggtggcgggcacctgtagtcccagctactagggaggctgaggcaggggaatggcgtcaatccaggaggtggagctttcagtgagccgagatcgtgccactgcactccagcctgggcgacagagcgagactccgagactccgtctcaaaaaaaaagaaaaaaaaaaaaaagaaagaaagaaaacacagccctttgcccgaagccagacagtgaagacggtgctgctgccctgtggccaccccacttcccaagctgttcaaatgggtgtcgaaggccattcccacttctacccctttgcaacatgccagcccctccccaaacacagacaggtcacagaggacaaaaaacatcttgccggctattttctctcttcccttcccaacaatagctttatttagttcccctggggatgccgaggtctgcatcagcctctcacaggctccctgtcccgctcacatgccctgggcactccagagtgcagcactgcccagtggcgtaagaggcctgacatcctgtcagaaggggcagaccgattttggaaaacagagatccccacccagataagggctttattcaaaagaacccaaagaaaccaaaatactcggggtagcccagtgcctatgctgggtgttcccttgggaggattagagatgggagtggaagcccaggtcagcctagtcacagccgcatcctcaatccacagagtcagagaaacaggactttagagtggcccggacagcctcccaccaaaggaggcaactcctcctatgttcttgactctgaagatttaaatagtcagagtctggtcctacgtaagcgatgggaaaatcaagatcgagaagaatctggaggaagaaatcaaggactgaagtctgggaagacttccaggaggagctggcctccatttcctgcctccaaggctctgcctgatccagctctcccccatgtcttctgtttcatctcatgtgtctccctcctcctcctcagcccaacccctaactcccagttacagcctactgacctttcagttctttactgaatgtgccgcactccctccagccacggtctttgcgtaagctgttccctgtttccctgagataccctccctcacactcttttctaggccaatcccgtctcatactcatgtctccgctgagataccctccctcacactcttttctaggccagtcccgtctcatactcatgtctccgctgaaattctgtccctgaaaagccctcccgggccactggtctcccgtaggcacttcctgttatcttctctatctcactctgagagttctcttttcctagctctagacaccatttagaattatacattcatgactgggcgcggtggctcacgcctgtaatcccagcactttgggaggctgaggcgggcagatgacgaggtcaggagatcgagaccatcctggctaacacggtgaaacccactctctactaaaaatgcaaaaaaattagccgggcgtggtggcgggtgcctgtagtcccagctactcgggaggctgaggcgggagaatggtgtgaacccgggaggtggagcttgcagtgagccgagatggcgccactgcacaccagcctgggcgatagagcgagactccatctcagaaaaaaaaaaaaaaaaaaagaattatacattcatcttttttttaactgtctgtttctccactccccataggtggtctgaggacaggaactttgcttgttttgtttaccactgcgtctctagactctccacaaggcccggcagacagtaagcgcgtttgttgaatgcgtattagacgaagtctcccacaacaagcgggagaagtcatatgcgaacaggcagagtcaggaggaatgtggtgattcgagtggaaggtttgttggggatgcagccagaattagggcggacagatcaggaatggcaagcttgggaagggcctggcaccagaggtaggagtttgaactgtgtttcatggctaccaggcagccgtcgagggtttggatgcagtggggtagacacctgtagagcaggctttaggaagagttctctggaggctgtggaaacaacagctcatatctcttgagcccttagtgtgtaccaggcatggggctaagcactttacatatatcgccccacgtaagcctcttgatacttcttctgtgaggtagctcctatctttattccattttacatacatggaaataaaggcaaagagaggtgaagtttttggcctaagatcactcagcaagaaagtggaagagctaggattcagccagagccacccgcccctgctccctcctgcatggtgccgcctctggacaactatgatcatccagtgcttcccctgcacccagaactggagcacgtgggtggaggccagcagacctgttaggacaagactggctgcagtcatcactgggcagggcagggcaaggtggcagcagcatggacatgggtagaaggatgccagttcacttctggctcccacatttacagttgtgagcccttgggtaagtcaccgaccactctgtgactcagtttcctcatgccccaaataggaagatcacttgaatcccaccagattgatgggaggaatggacattataatagattttggtcactgaggagttggtcactggatggttgttgctagtggagaggcacaaatgaacttagaggatgcccagggcctggctggcctggagtaggacggcagtctgcccttgctctcatctcctccacatctatgatctcaggggcacggcagcaagtgggggccatgggatgtcaaaggctgatctgttattccttggaagcaggaagggaagggaaggggaaggaagcctgaggcccaggttgtgagcagggagcgcgttacgaagcctttgacagaaatggggcagcccggaaatggggtttgtggtagacatttaaaacagactcattcaacagaaagcacaggagcactcccacggctgcttcataaagcttaaccttgctgtgtagcatctgacagactctccttggaattttaagcacggcacatagagacactcctgtcaggaggaggagcacagacaagatgacctttgcaactcttctgtaattctgccatgttgtgacaaatctaccaaatgccatttagaggagtgaaatgtggaaacgcaaatatgttaagacaaaacttcacggcttacggggctctgtgtggtctgacccctgccttctgctccaaacccatcttacccacactcccccatcagcctctctggcccaggctcagtggctttctccccagcctggatactagtatactagtgctgtcccctctggccacaggggctttgcatatgctgtttttattgcctgcagcgaagtccctctctgctcctcttcattcagccaactctttattttttattttttatttttttaatttttaaataagtatttatttaaaaaataattatttatttatttatttttattatactttaagttttagggtacatgtgcacaacgtgcaggtttgttacatatgtatacatgtgccatgttggtgtgctgcacccattaactcgtcatttaacattaggtatatctcctaatgctgtccctccccgcctccccccaccccacaacaggcccctatgtgtgatgttccccttcctgtgtccatgtctgcatgcttcagaagtcagctccaacatcacctccccaagcagctggcttgcatctccctgcctatgtcacagtctgctcatctgttcttccttcttagccatttcaaatggatctgtgtgattgttgaggaatgtctgactccaagagaagcggtggggcagtgtctgtggctgctcaacattgaaccctcaggcctctcctgaatgacagacctgcctcctgatcccggccgccaggtgctgctgcagaacctgcaactcaacatttccaaacaactgcatgaattcccatcaaaaatgttctcttctcttcttgtaccccaacctcagtcaacgctgccaccacccgcccaggtgcccaagatagagatcctgcctgccttcttcatccttatacctgtcctgaccctggtcaggcacacaggagggcccaggagatgtttgcagagtgaggtctgtggtctccctgcccagcctcgagctctctggccttctaatcccacctctgaactccctgcatcacctccttccaccttaagtctgtcttgggaaaataccggtagcatattcagaaaaatgaaacgaaatctgccctaccaaaaaacaaatattccattatcttacatttcctgtttccctgagaaacggaatagtcaaaaataaacaaactgataggatggcaatatttgtctgcttttcttgttcttgcctgtgtgatgtttatagcatagaacaggttcagtctcccatgaggatcctcctgggtgacactcaccatgcagacaacatctccagcaaactgtggctctggggagggtctgaatgatcctaaatgacggggaagcgaagaccaccctgagccacatggatacacgcagctgcgggatcacagaccctctgggcttgtgctataatttactttttttgacagtcttgttccagctgcatctgtagatggggaaaagcacccctttccaagtcagatgacccttttaaaaaaagtatttattcttgagatggagtctcgctctgtctgtcacccaggctggagtgcagtggtgtgatctcggctcactgcaacctccgcctcctgggttcaagcgattcccccacctcagcctcctgagtagctgggattacaggcacgtgccaccacgcccagctaatttttttgtatttttagtagaggtggggttttgccatgttggccagagtggtctcgaactcctgacgtcaaatgatccgcccgcttcggcttcccaaagtgttgggattacaggtgtgagccaccatgcccagcccatgtcagatgatccttaatatgggaattactgttcttcttagttacttcagaaaatagttgaataacaattacttcagtgtccacatttctttgcttcagttgatgttcacacatttaatgtcttaagattaaagataaatgtaaacttttgtttaaaagtactgttgtcttggtattgcatagaagaaatactgtttgcttggggctgtaggcaaaggcatttcatctggttcagagaaactatttgtgcagtgccatgaaattagctggaagagagaagataggctttgaagccaggcagacttgcgtttaaatatcattagcatcagttcctatggggatatccttggcaagtttcttagcctttccagtctcagctgctttacctataaatgggaataagcacacccaaaatcgacgttgttgtgaagatttgagttttcatgtaaaatacatgttataggtatctggatcctagccagaaactctttggggataatttaaactgatacgcagttaaaatcagtacaactccccctccttcaaattagtacttgatacagtgatagccattgctctttttttcttcttcttttttttaaagttttcctttttgtactatttattgtaaaaatatctgctttgaatttatttttaaagttattaaattgggccaggcctggtggctcacacctgtaatcccagcactttgggaggccgaggcgggtggatcacgaggtcaggagatcgagaccatcctggctaacatggtgaaaccccgtctctactaaaaatacaaaaaattagctggacgtggttgcaggtgcctgtagtcccagttactcgggaggctgagggaggagaatggcgtgaatccgggaggcggagctttcggtgagcggagatggagccactactccagcctgggcgacagagtgagactctgtctcaataaatgaataaataaataaataaaataaaataaagttatcattacattgaataatgaatttgtctgatattccttatataaataatgattctatgtatttatttacctgtgcagaaatatacttaaactctagtgatgacatcctgcctggtgttttttttttttttttaagagacagggtctttctctgttgcccaggctggagtacagtggcgtggtcgtagctcactgtaatctcaaactcctgtactcaagtaatccttctgcctcagcctctccagtaactgggactacaagcgtgtgccaccatgcccagctaattaaaaaaaaataaataaaagtgtttttggaggagacagggtctcgctttgttgcccaggctggactcaaactcctagcctaaagcaaccctcccacctcagcctctcaaagtactgggattacaggtgtgagccactgcacttgacctctgcctggtttttatcctgtaaatcttgcataaccttttaatgtaattcagtgaaatctgacccactatagctgcagagatggtgcccgaatttttaaactgtttacagctgttattttacaactttattgagatacaattcacataccataaaattcacccttttagaaatgtgaaggaaactagtcataaaagaatgtacaattcagaccaggtgtggtggctcacgcctgtaatcccagcactttgggaggccgaggcaggcagatgacaaggtcaggagcttgagaccagcctgggcaatatggtgaaaccccgtctctactaaaaatacaaaaattagctgggtgtggtggtgggtgcctgtaatctcagctactcgggaggctgaggcaggagaatcgcttgaacccgggaggcagaggttgcagtgagccaagattgcaccgctgcactccagcctgggcaacagatcaagattctgtccccctgccccccccaaaaaaagaaatgtacagttcagtgcttgtaggttattcacagagttgtgcagccatcaacactacctatgtttagaacgtttttatcactcaaaaagaaactcggtacatagtaccagtccttccccatttccctggagccccttccagcctctgatgaccaatgctctactttctgtctctacagatttccctattctggacatttcagacacatggactcaaacaatatgtggccttttgtgactagtttccttcactttgtatgtgtgtttttgttttgttttgttttgttttgttttgttttgagacaacgttttgctcttgttgcccaggctgaagtgcaatcacgcaatcttggctcaccgcaacctccccctccagatgtcaagcaattctcctgcctcagcctcccaagtaggtgggattacaggcgcatgccaccacgcctggctaattttgtatttttagtagagacgggttttctccatgttggtcaggctggtctcgaactctcgatctcaggtgatacaaccacatcagcctcccaaagtgctgggattataggcatgagccactgcgtccagccactttgttttgaaggttcatccatgttgtaacatttatcagtgcttcattctttttattgccacacagtattctgttgtatggatggtgtctgacgtttaattatattttggaatgacctggatatgtatttccagtgattgcagaccatgaagacaaatgaatgtctaggaaatctcaagaatatgggtaatactttggcaacgccctggatcagaagtgatttctatacctaactgggcagctcatgaatttttaacatttgggaagaaggagggttttcacaagtgaaccaacactagcttgcagggtcttgcatcctgtgtgaaaccttttccgtctcatccactgttgtatctttggccatttgagagcagagggcttcagctagagttttttttttgtttttttttttttttttttttgtgggggggatggagtctcgccctgttgcccaggctggagtgcaatggcaccatctcggctcactgcaacctctgcctcccagattcagatgattctcctgcctcagtcccccgagtagctgggattacagtcacgcaccaccatgcctggctaatttttgtacttttagtagaggtggggattcactatgttggccaggctggtctcgaactcctgacctcgtgatctgcccgcctcggcctcccaaagtgctgcgattacaggcttgagccaccgcacccagctgagctagatcttttgtacaattattggggtgagcaagatctctgcttctggcttattcttactttgtcatcccatgagcaaggtgataaagagaagggctaagaaggaagaatgttcaggatgctgtgacgtgataagaaacatgcatttagtctgtgcttccagttcctgagacagagctcctaaaagccttgtaatttcctgagtgacaggggtgctgggagcatcttttgttctaatgaggccactcttggtgggctcctggatagcttcaggatgggggctggtcaccagattgaggcttgaatctttcagtcccacccttcatcctctgggaaggagagatgggatagagattgaactaataattcttcatgcctatgtgatgaggcttccataaaaatccctcaactacagaactggagagcttccgggttgctgaaaacctccgtgtgctaggagggtggtgtgccccaactccatggtgatagaagctcctgtccttgggacccttctggattttgccctatgttcctcttcatctgactgttctttatatcctttctcacatctcttataataaaccaataaatataagtaaagtgtctcctgaattatgtgagcagttatagcaaattatcaaatatgagcagggacttatgcgaactccaactccaactccaaccagtcagacaaaagtgtgggtaccatgggcacccaaatttgcaactggcttctgaagtgggggacagtcttgtgggactgagcccttaaccggtaggatctatgctaactccagatagttagtgtcagaattgaattcaattgcaggacactcagttggtatccacagagaactggataatcacttggtatggaaaacccacatatttagtgtcagaagtgttgcgagtagaaaaatagtttcgctttaggggctaaagaaaaaagtatagagaaatactggaggccacgcatggtggctcacgcctgaaatcccaacattttgggaggtcaaggcaggaggatcgcttaaggccaaaagttaaagaccagccaaggcaacatagtaagaccttgtctctataaaagaaaaaaaaattagccaggcatggtggcacatgcctgtagtcccagccacttgggaggctgaggtgggatgatcacttgagcccaggaattggaggctgcagtgagcagctgcaccactgaactccagcctgggtgacaaagtgagaccctgtgtcctaaataaataaataaataaataaatgatatggtttggctctgtgtcctcacccaaatctcatgttgaattatatttcccaatgttgggaggagggacctggtggcaggtgatcggatcatgggggcagatttctcccttgctgttcttgcgatagtaagggagttctcacgagaactgatggtttaaaagtgtgtggcacttcctcttctctctctcctgctgccatgtgcaaatgtgcctgcttccccttcaccctcctaccatgattgtaagtttcctgaggcctccccagccatgcctcctgtacagcctgtggaactgtgactcaattaagcctcctttttttttaataaattaaaaaattttaattaattttttaaataaagtacccagtctcaggtagttctttataacaatgtgagaatgaattaatataatacagtaaataaataacaaataaataaatatgaataaataaatattggtacagggtaccagcagcagggtaggagagagaattatctctagccctccctcctccttgcaaggccattgcctcctcccttctgaaaatgaccttcattttttcaagagctcttatgccatggctaactttgaagccattcagaggggaagctttgagacctggagttaatcctgccaacaaggaaagctaaagttgggtttgccctgatatatttatttccacgtttatttgagttccgtgagggcaaggatagcattcattttgttcattggttgcccaacatggagtaggtcctctgtaaggattcgttgatgggattcattgaatgaatgtaggcacacagattgccgagagctctgtaaacgtcaggtgctgttgttgttaccattatcattattacgtattgactgaactacttttagagtatcaaaaactcccctgtatcaaaccctctgccattccaggtgactggtgctctcttggtgtctttgttgtttttcagccctgcctagggtgcaccatgctttctttagcttctccttcacccttccttccacctacggaagaggctgcaaaacacagtgagcacttaaaactacagtctttgaagccagaccacctgcgcttgaatctcagccctaccactgctgagctgtgtgtccttgggcaagttgcttcacttctctgtgcttcaagttctgcatttgtgaatagggctaaaagtaggatgctccacagaggttgtctcagggtttaaatgaattaaccggcacaaagcactcagctgggcatacagggagtgctggctgttggtattattgttgttaacccaactgcattcctgcaactgctgttctgtctcactccattgctctcagctttccaaagtgacatctgacaggaggaatctgggcttccgtggtagaggctggcaggggtttaatgggctaccggtgtgccatgtatctgcagccgatggatgtgtgtgggtaacagggaaggctgccctgagatactgactctgagcccaaagagagagatggacaagggtcactccagctccttcctgggcctggggtcaggcagctctgtatggacacagtggagggatttgatggtcccttgagggttattgcagctgccaagacccccagttttcttcattacactatattggggtctccccttgagtggacagggggatgaaccctgtctgaccagtggtggggaggtggggactcacaggtcacccagagcagcagagctccttcatcacacaaaggaggaaactgaggcctgggaagcagagactgtgggcaggtcccatttctagtcatcatccttcaatctccacttcattctgcatttgtagctattattaatgatatacaaaaggccgaaggcattacctcaactttataaataaggaaactgaggttcaagcttgtcaaatgaagctgtgaaacccaagccttaaaactcaagagcggggccccctcctcggaatccagaagtagttttgttccatccccagtcttctgcactggaaaaaaaactttatgaagcacatactgtgctggccccatggaaacagcccctgactccaagggaccttttattctgcaaatttcagacaaatgttccaaaaaaaaaaaaatactgccaatggggaagaataattggaaagtaaaaaattacccccaccgtggttgggagccgacagtggtgacactctgctaagtgctgatgtgcgtttaactcctttgatcctcgcaatgactctttgaaagctacagatgggaggccgggtgcgagtggctcatgcctgtaatcccagccatgggaagaatcccagactttgggatccaccgctgaggtgggtggatcacctgaggtcaggagttcgaaaccagcctggccaacatggtgaaagccggtctctactaaaaatacaaaaattagctgggcatggtggcaggcgcctgtaatcccagctacttgggagactgaggcatgagaatcccttaaaccaggaggcggaggttgcagtgagctgaggttgtgtcactgcactccggcctgggcgtcagagcaagacttcatctaaaaaaaaaaaaaaaaaaagaaaaaaagaaagaaaactacagatggagaaatggagtcagggagggaacaacaggggcacagggtcgcagtaagtggcagggctcggctccatccagctctgccacattctggaggaggtgggaaaagtcacaaggtgggaacgccactgctctcagtttagggagtgggctttgagggatagcacgctctaataagggaatcatacttgttctaagaggctggccatgaagcagttttaaacccaccctagtgtgtgaaacatcacagcagtgctcagagagaataacacaggccgctttttcccacctgtctgcagggagtagagatttgggaagaggagggctgttttggggctcgttcacagcacggctgggccagaggaggtcttcctgggagaaagggcatccaggtacgacagggacagcttctcagctgcaaagtggagggaatgcaatgggggcggagtctccctaacttctgtgagtgaacgtgtgggaatggattggctgaaagccaagctgcaagatcctccctaggtcacaactggcctggcagacggagccttcctagacacctgaagttcccagggaatgcaggatgccaggagttccctgcaagctgcgaggagagaggggcattcccctggacccagccaggagccggagtgacagcactgagtttccgtgtagaagcccccagggaagggtgcagagttcgcagggcctgctctcctgcatgggggcaggaggtggggggcaggaggtgaggggcagcaggagcctcgaggtggcgagctggtccatggtcctttactgcaggctcagtggcccaggaccagccaggaaacttccagggtctctgacagaggggaaaacgaccagggcccaaacacgactagggccttatgctaaggacggacatgtctctggctgaggggcccctttgagggaggagtcattgctgacacctggtgatgaaggtcacaattgttcagtgtctccttgtggcagtcgggccacagtagccgcacagacacagggcactgaatccacacgagaggcctgtcatagtgctgagtataatagcatccctagttcacaaacaagaccactgagactcaattcaatagcttgtccaggcaaggctgaagccagaatccatgcttggggaccagatcgcctctctgggggacacagaaaggacccagaccctaccctcgaagggttcccaggctggtgggggcagcagatctgtaagcaaatgatttcaactcagaaatatcaacattcaggagaattacgaagaaaaaatgctatagaagcaaagaagagtgagtgatgacctgtggaggacaggaggttgttggaagaggtatcatggacagtgcataggggaaatttgcactgggctttgctggtcatgcaggagtgtgcccaacagaggaaaggacgttccaggcagaagtggccacaaaggacacaaggcccaaaggtgtgaaagtggttggaggattcaggaaacagggccaaccacagggatggaaggtcaatggaaggcgctgcgggagggaagggctggccaaggcttcacgtttaagaagggcctcaaatagagattcctcaatggtctctccaaatgagggcagacatacaatcactacgccgtgtgtgtatggatgtgggtgtgtgttaaaaacattggcttgttaaacgtgcacattaaagctgtaccacaaattcagttattctgcccccaacaaacttggagcctcaacaaaaaaagaaggaccctcctcatctgtcagaaatacatgctgaagtattttcagatgaaaggacatggtgtcttggattggctttaaaataatccagtgtggggtttggagcggggatgggtggggacgtggaggtgatgagattgggcacgtcctggaactgggcaatgggaatacggaggcgcctcacatcactgactctgcatttgcttacatttgaacatttccatgacacatctttttttttctttttttttttttaaagagagagagccccttgttctgagtcatcccgtggagctcaggatattcagtatagggagagagaaggatgaatgatggggaagcggggtgggacccagggctgaaaggtagatttggagccaaattgtaaaaagcctcgtaaactattctgagaagtttggacttaatcctgcaaatagtgggaagcccagtaaagaatttttagtaggggaatgacaccattagattctcatttaagaaagaactcttctctggctggtgcctggaagatggaaggggtgtgtgtgagggaggcagggttagggagaggaggggttggggtcagggagaggaccctgcccgaggcttgaggagagcttgtcagctgcgagtctaggtgggcgacctgccttctcctctatgctgtttctggagcaagacctcttctatctgccttagtagtaggcactctattgtgattacttatcacaataagtaattccttattgcaatacatcaataaggatcacttagtgactctctctctggctagactaggtgtagccacatcacgcctatctcagtcccttcttatccccggagcctggcatgacgcctggtaataaaccactgttaagtgaatacggaaatgtatagcacagggctctccctaaccactaaatctttgatgatcgaacggacagatccagcacagtgcctgacacagagtcgtagagtagcccctcaataaatgttcgggagccaaactgagctcgtgtgaaattgtaggaaactgatgcctgagtggggcgaggagggttcaggtctccccttaggaaaaagcaatttcctcccagcacgagagcttccaaaaaggcagtggtttccaagctgaaagtggatgggaacaaacaaaccgggcacaaggtttgtctatgaatgtgtcagccctcgaaacttatgtctccacatctctcttggctccttgatgaggtgcttcctccatttcagatggatggtgtttctttcccccttctaaaaaaagcttctagatgcttttaaattaggcaaatgagcaagggcaatgttcattttcccccctttcattctgaaaatgtgtggcgtgccagaaggcctttggacggaatgttcagaggctgcataatagaacaagagaggctgccaagctcctaaatcactaaccagacaatctcaggccctgggacttagagacccctgggacaacatcatgagctgagtccgcaacaagtgaaaagatggcccacagcccaaggtctcagcaggaaaggaagcccctaccttgaacagctgaaagttcaaagtgggccacagctccttaagctcagctctctaggagttgcctggtgatggaggaccttgggcccccttctgtaaaacctcagggagtagatccaatgccaacactttctttgtgaagctcagtttacccactggtaaaatgggtctaagctgaaggactgcaaaataatagagaggactctaaatgcaggtgtttctacctgtgacctcctctctatagaatctgtgaggtccagagccttaatattgagcatttggttgcagggccagcagcatcagcatcacctgggctcttgttagaaatgcagactctcaggccccaccccagaccggctgctcagattctgcattttcacagcatgcttaggtgattcatgaacacgttgaggtccgacagcactggcctacctaaccatatgatcgtggctaagtcgctttaccactggattttaatttattcatttgtaaaataaaagtgattaatttaaatggcacatagacctgaaatcctataaagttcatagcctgctaataaataccagcctttgatcccaaaatgtacataggagttccacccctgttctgaaataccaggttttgaattgggtcagataatcaacagtggaggtcactgggtcagactgtgctagagtgatgtggaggaataaatgtgaacattcattctggagggtctaggacaaacccatttgaaatactgtgttacactatgagcccttaaatctcaaattttggtttggaaaatagaggctcccatagcatcagacacagtcccaactcatgttaggttgattgcactgatagtatcaattactgactttcctgtgtccatgacctttacaacatgactatgcagttccttccaccaagagaaggcatctgttttcccaccctttgaatctgggctggccttgagactttctttggccaaggcagtgcagcagaagtgtcccagttctgcctaggtccccagagacattgcatgtttcagctctctctgggaccccgtaatcattttgtgaactagcctgggttagttggctagaagatgagagaatacgtggaagagtgcctactcatctcagatgagaacagccaggactggcttacagccagctgacctccaaacacaggagagaacccagccaagatcagagctaccgacatgaccacaactgaccaccaatggatgaataagaccagctgagactagaagtgccacttagctgactcatagatttgtgagcaataatacattcttattattttaagccattgagtttttgggtggtttgttacacaccaatagctaaccgatacataaaccttaaagatcttaaatctggttggaaaaaatttcaaacttctaagattgcctctagcttgaaaatgccatggttctttacaaaagaaaggtttagaatatggtgtcaaaagtgaatgccttcaggggctttgagtgaagagagccagtgtactccaaaaactttttttttaatacatatatgaatcacgaaaggcatatttctctacttccacagggaaatcttgtggcttccattttccttgaatcctctcagtttgccttttgtttcttcacttttggtatagacaaggtaaataagacatattttcttttctcctaacgataaggccaaccaaccagcagcctcagtatgggggaacaacctggagtggtggggactggggcaaaataaggagcatatacctggtttcagtgggtcaatggttgtcttaaaagaaagagggccccaaattgccagatcttctcaattttcaagagaacccggaagcctgcatttttggatatgaacttacctaattttcaaacttgagttcaaattgttttaagaagcttcacaacccaaatcactcttttttttttttaaacggaatctcactctgttgcccaggatggagtgcaatggcactatctcggctcactgcaacctccgcctcccgggttcaagggattcttctgcctcagcctcccgagtagctgggactacaggcacgcgccaccaagtccagctaagttttgtatttttagtagagacagggtttcaccatattggccaggctggtctcgaactcctgacctcatgatccacccacctcggtctcccaaagtgttgggattacaggtgtgagccaccgcacctgaccaacaaaacacttttgatggctgaagttggtcaacagctagagactcctggtgtggactgctaatgcagaagggttctggagcaagagcacatgaccatgtaagacatttacaccagatccctccatgctcccttgggctcaccaggagagcagctccagtcagggaagtctccctttgctgggccacttgtgttaaatgatggtactgcagctttaggagggtcaggcaggctagaaccacgctgagggccaggtaaagctggtcctggtaacttttgccttttttttttttttttccattttaggggcctcgctgacctgtgacttcatgatctcatcaccccagtgacttcaggaatgaaccaggaacgtatgctccaattttaccccttattaggcattttagaggggataatgattcactgaaagactggggctctaaaagaaaaaccatctcagatggagggtgggcaggacagcttggattttgtgactgctgtttacatgtgctgtgtgggtgctggtctgcacaggagccctgggcttgggggtgagaaaaggcagatcttgccaagcaatgcacctggtgctgggaactgcttctcggcctgaagcgagtgctgcctttcccaaatttcccttacagggggtgccttttacctacctcacccaaggtctccctatgtgctaatctctatttcagagagagggagaaagacattatggaatctcctctgttaagcgctgcctgcagcatttcgaagttaggtaatatggccatttcacagaggggaaaactgaggctcagagaaattaagagactcactcacgttcacccagctaagaagtggaagagcaggcctcctgactcagatctatgtgtccatcccaatgcccaggtgagccttgctgggtccccagaggtggggctgaggatggtgacagataggtataactcctgatataactcttctgcttgacctgggcacctcatttcctcccctacaggaagggtggagtgagctctgtaagtacaggctaggggtggggaatctgaaccccacaaaaggccctgtttgcttacagtccgcacagctgggctggattagtccagcttcgtaaatagctttcgaaaaccagccgactggaaaagtccactttgtcctggagaatgcacaaaggccccacccacattcatcactgtccgctgccctgtctccccaaccctgacctctctatcttgtggcccatctccacctcctcctctgggcctcagttgaaaagaaaattctcaaatccccgttcccacctctatcaaactcttgaaagacagaactggaaggagaggcaaggaaaaggaaattcctttgaggtcgagctgcctggatttccttctgcatcctgcctcatttccatggagcctacctttattgatttgggacctgggtcttgaggaaactgggggctgaatttggggccattagtgaagcccagggctgcttccttcctgaggggcagctgagggggaggcccagcgctggcctcagaggagagcagctggaatgtgttttctcacagccacacttcggttaacattccagaaagtcagagctgggaggggcttccagattagcaagtccaaaagactctgaccctgggttcccttgttgagctgcaaaggggctgtggatctccagaaatcggatgcaaaaaaaaaaaaaaaaaaaagtttctctgtactagtgaggaattggatttttgcagggagaggcttcaagcttcgttttcttaaagggggctgagacactcttcctacaagttaaggacacaggatgtttctagtttagcttgtgttttatgtagaaggggaaactgaagcccagggaggggacatgacatgctcagggacagagatgtgactgagctcatttgagagcacagcagaagtgtagtttaggggagggaggggcgagggagacttgttcctcctgaacacattttccgaaagtggggccttttcaacagtgtctaccacaacagattagccaaacagctatttaaaaaagggatcagactttaatggaaggagcatgaaagtgagattgtgaaccccagggagagaaagttgtcacagattgtcaaaggatagtttttgcttttttttttgtcatagtttttttttcaatggagacaagatctcactctgttgttcaggctggacagctggggcatgatcattactcacttcagtcttaaactcctgggctcaagtgatcctcctgccttggtctccgtagtaggccaagggactacagatgcatgccatcacagctggctactattttatgttttattttttgtagtgatggggtctcattatgttgctcaggctggccttgaacccctgagctcaagtgatcctcccatctcggcctcccaaagcactgggattacaggtatgagccactatgcctggccaagtttttgaaaatatgtattgtgcacttccagcaatcaatggcggtcttcccataaccccaacctgcctgccctgcctggcctgcaggcctagctggcaaacctggatatgctcctggatccctggaatccagacgtgccacttcccactccattcctctccttgccattcattcagccaatatttattgatttctttaactctgtatgagatgttgtggatacagtggtgaacaaaactccatcttcataggacttattcaaattgaggaaactgatggcatttttctaataataagaggggacttgggtccagggtggggtggctgaactctgtcggaaaaacgcttctctgtgagtgccgaggtgtcccctcccaccataaaagagggttctgacgggaatcgaggacaccaatgcccatttgtttcagattcgacattctccatcttgacagggtccccaaggttctcctgagtccaaggacaccgctgcctcccagctcataacaaacgatgctcacaagcatgccagccctctccttctatgaggcaatcctcggaggcccttgccaagatcaactgtttggacttctgccttgaaaactgatcctcttccgagtccggttattgcttttctgaaacatggggacagtgacatcatcgctccctccctggcttggggatttggtggtcagcatgaagtcagggtttggaacggtgcctgttctctgccaatgcccagggaggcctgggttgggggctctggagtgaattgggcttgctggggaagtccccagaggctgggtggggggtcactttcaaacctgttgccagcatctgggtctgccttgcagtccccaggatgagcagcattctgaggagggctgaactgatggtcggtggatacacacctgcccggtcatacccattgtcaggctattgaaatactttcatctcattggtagtcatttaccgggaagacttcctgccaccttagctgtactggcttctcccctgggccacctctccataactcctaccatctaacacctgtagggacctgtccaacagtactctgattgttggtgccctgcaccacacccatggataaagatttcggcgatgactccaggatcggagtggagctgtgagaacttgggctgggcctttggtcgctgggcacctgctggaaggcactgccatgtggaaagaggcaaggtccacatctaaagttcccaggtctgggccctgccaacaggaattctctcctgccacggtgggacccattccttgcacagtcaccggttagcatttccttgccagaggctgaaaggcatctcaggggtattctagtcctgcccgctaattgtacaaggagactctgcagctcagaaagaggatgtcacttgctcaagtcaaataagctggtgactgacctaagccttctgcctaccctctaggtcatgattctcaaggcacacaaagatcctggcttcagagaccatgaagacattctaaaccttctcctatcacttgcccgctgcctttctatgcccagggttggtttattggcatacccagcactttctctagttgggtggattttagaattagcttcagcagggagcccgtcacagtcatgtcactccataacctggcatgcacctaggtaggaacctcagtctggcagcccacaggctgaatgtggacggatttcactgggaccacccagtgttgttgatttttctttctaatggaatagattgcccacacttagaaagtgagggatttcatacaaaactgtggatatggggctttttggaacaatggttagatccagccatccatgtgccacgtttctgcaggcaagaccagctccctataaatgggacagatgctctagtttgtcaccaaccacccctttctcccagctggctttggtcctttgctggcctgaaggcacccaagtttgccatccccagcccagagttatctcagtacatgacacggccttgctttttgtttcttggaaaagttgtggtccagacggaataaatagaccactttagcatccttcttctttcttcacacattcaggccattttggataagggagatgtttggggtctcaggcttatcacagggacagtcattggttgaccacctggctgtgacttccaagactccttccttctgctcttcccacctcttcccctgacagtgccatgatctccaaccaggctacccaactcctgacattccatggctgagctttggactgagttgtgcagatgcttactgagcacctgcaatgttgacgccatgtgaggattcaagcaagagcaagacacatttttggatgcttagtcttaaggatctaagtcttcttgtgcacaacagataaagatatcgataaccgtaagtcaaggccaaatattctgcatcacaggaaaggtttcaaatcagacagagctcacgtctactgggtggggaaggaggaatcaggaaaggcttaaggaaggaggaatcaggaaaagcttaaggaaggaggaggtgtttgagatggaccttgaaatgaccgtgaaaggaaatggttgggggtagagggaggaaagggtgttcccagtaggcagagggaatggcttgagaagaggctgggcttgggaggagactgtgctgagggtgcctcttgtgcaacacagcttggccagcactcacaggcaggacacaccacacatctttcctgccaccctcctctgcacccagggacacacacgcatctctctgggcaggggcacactcagaagctgagacttctgtacacctcccaaacctgacaacaatgtgtgctgagatgttagggatgatgtgggacctaaggtggcaaagatgggctgcggtcatttctgggagggctctgatcgtcctggtagaaagtggggttagagtaaggcagggaacctgttcaagtgtagacaaagagagaagagttcattaggaatttacagctttgagtaaacaaggaccgagagtaggtttttcagaggggaggaaggaaggcgggaaaggaatgagcacttgggcagagctgagaaagatggggactctgttgacctgccccaaccggggaatggtggagcagggagaagtgtgggagcacagactcatgaacttgccacaaaagaatcacagaatttctgatgtggaagaggctttggtgctacccagtttaacccccttatgttatggaggacactgggtgccccgagtgtggaggtgcgggcaccaatcctagggtgacaaagctgtcgttttatcttccacagcgtctatcatgtagtaggtatttggtgaatgtgtgttgaaacgatgaaaatgttgacttctacctagaactgacctcgtaaaatggaaaatgaggtccctggacacctggttggttggcaataatttccatgtaaaggtgttgtctccctgcacccccagctttggaggaagcccccagatgatgctcttatgcccccacacagagtctcagttcccatggagggcctgccactggctggggcgtcgaggggtagcgagctgtgcggttcctccttccctcccacccaccctcccggggtcgttgtgtaagtggggggtggcagtgcggcgggcgggtaacttcctgcaacagcggcagggctgggcatccgagctggcacggttcaagtgcaccacagcattctgaacatttgggaacacaggaagggctgcgttttttaagctccctttgttttcaaggaggggccagagtccatggggaggaaagaaacaaaaccaggaaaacagatgacttgctttgcaaagatagtgtgtacgtatgctgcagcttctgtgagccctaatgctctgctgtccctctacacttatgcacacctacacaccctgacgcacactcacggcaggtcacaccacacatctgtacttccatctttctctggcacccagggatgcagacacacatctacctgggcagggacacacccagaagctgagactttgatacacagagacacctcccaaacctaaccacagagggacatccacacacatggatgggcaagtgcaatcatacacacatgtaggagtatgaagctttcatgcatagacatccagacacccagacacacacagagacatgctcggaaactccaagacccccatacttatagaaagatccagactgaacacacacacacacatatgcaggcttgtgtacacacccatccctccttgaagaagctccacctgtacaaacacagaggagcattttttttgtttgtttttgtttttgtttttgttttgagacagagtctcactctgtcgcccaggctggagtgcagtggcaccatctcggctcactgcaagctccgcctcccgggttcaagtgattctccggcctcagcctcccgagtagctgggactacaggcacatgccaccacgcccagctaattttttgtatttttagtagagacggggtttcaccgtgttagctaggatggtctcgatctcctgacctcgtgatccgcccgccaaatcccaaagtgtggggattacaggtgtgagccaccgcacccggccagaggaatgtttttaccaggggtccagggagcctgcacaccctcagccctgctctcggctaccagaagagtgtgggcaggcaagatacagttccaaaaggctccacagagaggggccaatgagtccttttgcttttccccttgctcttgatgttagtgtttctagaagcttccatgtagtgccctcatttaatttacaagtttgaattcttctttcacaaggtatattgaagaccattactggaagtgaggggagatgaggaggaagaggccctggaaggacatctgggactggtgggaacagcagctggattacctgctcctgcctggggatttctctacattcccaagctggtgctgacaaagtgcagccccaaagaggctgggccagagagattggaagaagagctctcaggggactcccacaattcctctgacaataaaatgagacagagaggttaaaagtcatttaaatttggccgggcgtggtggctcatgcctataatcccagctactccggaggctgaggcaggagaactgcttgaacctaggaggcagaggttgcagtgagctgagatcatgccatcgcactccagcctggggcacaagagcgagacttcgtctaaaaaaaaaaaaaacctcactcaaatctttagttacaagctggaagatgccgggctgttccccctgtaagctgtgctggccgctggtcatgcttcctgtggtgtgctttcaatttccctcgttgtaactgaaaagtgggggccttttctctgaaggaagaggctgtggtctcccaggtgccctgttgggctctttagggagggacttagacccaggagggctcctagacctgggcaggtagaattgctccgcctgatagaaagagaacctggagctctccaggcaagctgggcaggtttatgagctcggagcctgagaggtgaaaggtgaagctcctccccttctgctctgaccctgtcgtgtgtgctccccaaatatttggtgaaatccatcccactcagaaatcgctttggatttgagcgtgggatctgggtcagtgatagcaacagagcagccctcgaggtaggaacagaggcttccccatcctctaggaatttgcataaatatactaggagattgtgaaatgaatgaaagtccaagaaaatcacatctagatctgtgaggcaaggagagaggcccagatgccatctgggtaacatatgggaaagtgtttgcaaactttaaccactacgtaatgcaaagaatcatttgctatccttgttatatacaaaaatcttcatcaaaatgtttgcattgagcagttgaacctaatgatgaaagaggcttgcaagagcaggctggccgggtcagccctgggacagccagcccaggctttctcaggcaggcggcacggtgtggacgagaggttggtgggcagggattggcttcctgggtccaaacacctcctttttctcttactatctttcttgtctttcacaggtttatttaaacgctttataaacttttttctttgtattttgccagagccatcccctgggagcctctttgcaatcttccttctcgtccagctcccagtataagtcacctccttcaaagctctttgaatcctgatggtgcccttgactgggagaggccacatagtggggtggttaagagcatgtaccctggaggggaacagagctggatgatcagggccaggactagggtaaggagggtgagacctgaaaattaaataaaaatgaaaatgaaatgagatgaaaattaaataaaaatctgagaaggtgcctgcaaactcataaatcaaaataaatattttaatgttattttatataggtatgtatttttttttttttttgagacggagtctcgctctgttgccaggctagagtacggtggcgcgatctcggctcactgcaacctcggcctcctgggttcaagcaattctcctgcctcagcctcccaagtagctgggactaccggcgcccaccaccatgcccagctaatttttgtatttttagtagagacggggtttcaccatgttggccaagatgatctccatctcttgacctcatgatctgcccccctcggcctcccagagtgctgggattacaggcctaagccaccacacccggccgtatgtatgtatttttagagatggggtcttgccatgttacccaggttgggttaaagtgatcctcctgcctcagccttccaaatagctgaggctacacgtatgtcccactgttcctggccttattattgtgatatttaagtaaatgaatatcaatgtaaataaattcatgatgagcaaaatactaatattttaatgaagataggatccaaccctacatttgcataaccctgtctcacttgcctgccctgatctggtcctttctgaatttgtatctcggctctgcctcttattagctggggcacacttttaaaaaactgatgtgcacgttacaaacagtaaaatgaatacttttaaagagtacagatcaataaatgtttatatacgtgcacagctatgtgaccaacacttaatcaagacataggccatttccatctctgcggcaagtttccccttaggacttcctcttgcttaaaatgcttcagtgggtgttcactgctgtcaagataaacatcaaatccttttgtcctggccccttcacaggctacaggtgtgttccctactgttctatgagaagccaaatacaggtgtttgacctgaaaacaccagtatatctagcacatcccactgctgagcctctcaaagctgaccttggctctgaatttaacagcaactcggattccaaccctaatgctaacctcagccagagggatgtttaaaaatacctgcagagggccgggtgtggtggctcacgcctgtaatcccagcaatttgggaggccgaggcgggcggatcacctgaggtcaggagttccgagaccagcttggacaacatggagaaaccctgtctctactaaaaatacaaaaattaactgggcgtggtggcatgcgcctgtaatcccagctactcgggaggctgaggcagaagaattgcttgaacctgggaggcagaggttgcagtgagccaagatcatgccactgcactccagcctgggtgacaagagcgaaactccatctcaaaacgaaacaagcaaaaaaaaaaaaaaaacccagaaaaacctgcagaggccagatgatgtttgagatgttgggtttttgtgcgtattttcaaacgcttgtctctttaggctcttaaatcattgagcacatcctctgtatggctctgcttaaggctgaagtctgcaaatcctaaagttccttcagggacaagaaggaaagaaaaataaattcacctggagtcaagtaatttcacagatctttaaagcaggaaggaccttaggaaaccacctgatacaactctgggcttttgaaaatgagcaaccttagaattgctgtgtctttcctaaggttgcagtagtataataattacaccttttattgagaaactactatgtgccaggcatcaaagtgctttacattcaatatctcatttaatcctcccaccatcctatgaggtaggtactgttaagattttccgctttacagatgaagacattgaggtccagagagggtgagtaacttgcccaaagtaatacagcaacaagcggtgatgtattatttgaacccagcatgatcagactccagcacctccactctaaagcctgcattgcccaagccagagcccttttatgtcaccaaaggcagggaacaaatagtctatgaggtgaggaatttgcctttggctcttagattgacttcctataaaaacaagacagagagtgaagagccaggatctgtgggtttactaggcgccggagggatgctgaaggggaagatagtggctgccctagacagataaaggtcttgtggcaattcctggactgggggcctcattgctcaatgcaggggtattggcagtatgtgagtgggcctgcgcccatatcaccaggcagggtgtggagccctgggtgttccagcatacactgccaggaggggttggtgaatctcccaggacattgcaggcagcagcttaatgttaggaaaagagacttgaactggcaacctggacctgggcttctgctgtccactgggcagtgtgctatggcggtgagagctcttgcctgggcgtttagaatcccagctctgatatttacttgtatgggatcttgggcaaattacttcctcttcagggtctcagtggctgatccacaaacaagacatgtttgtgagtggtgcagtgtttgataaatcctaaactaatgggaagtagcccttgaccttggccgagacaccttccctttggggccttcgatctttcatctgtgaactaatgggagatgggccagagaatctccaaagttccttcctgccctaaggtttgatgactgagaatctgcagcttggtgcttaaaggtttggggcaggaagctaggggcagagcaaaggccctgtaggcattcaacagctgtttggcaatcatcctccttagcctttcccttcctatttacttctcagcctggctcaaggtttgattgtattactggtagaagaattaaccccaaacccagggaaatcgccacttcactgtgttttcttactgtcattttctattaacgtgacgcatacagggtttgcaagacccggggaccgccgtggatgtctttggcttctaattccattagttcatcgggtagttatggataataacacaaagcctgtcatttggccagcacttgagaatttatatagtggtcaagcgtgttcattccgaagccacaacccatgggttctcacccggctccttcacatacaggctcatgacgttaggcaaattacttctccactctgaaccttggtttcctcatttaccaaatgggaggaataaccgcacattgcctcatagggctgctgtaaagatgaagggatttgacgtcatgtacggcacttagcaccagactcatagtcataactaaatcatcagttattatttttacgaaatacttcatattcattttctgacttgtcacacccatcacctccatcagactgctttgattttattatcctgatttttgagcggagcaaacagactccgaggaacagtgacttgtcccgggtcacacagttaagtggcagagcccctggggttctaacctggggttcctgaaacctaggataggccatgttccactgtctccccctgcccttcccccaggaccaaatttctctgtggaataataaggtaatattggatgaagtacccccaaaacaaggttggtcctacgtgcgtaggcattaagaaaagaggggaatcctagttgttgggaaggcctttgggcctcaggtggtacgccgaggacagcagattttgacctccgaggcagagggagcaaggaaaggaaaaataatctttttttaaattttgagacagagtcttgctttgtcacctaggctggagtgcagtgatgtgatcacagctccctgcagcctcgacctcccaggtccaagcaagcctcctacctcagcctcccaaagtagctgggaccacaggtgcgtttttctcaatctcattttttttttcttttttttgtagagaaggatttttgccatgttgcccaggctggtcttgaactcctgggctcaagcaatccatctacctcggcctcccaaagtgctaggattacaggtgtgagccacccaacctggcacaaaaaaaggcatcctaggagggagctggcaccggcaaagacttggttttagaaatggacagcctacttagaggaccatcaagggactgccactgggacagagggctcttggagggaagttgtaagagataaaaatggaagcaatacttgctaacatttactgaatgcttacaaggtactgctctgatcactttatatgtatacgtaataacttactaaagtctcataactgtttttccaggtaggaaccaatattatccctgttgtatagataaggaaactggaggcacagagaggtttaagtaactcatctgtggctacaaagctgataaacagccgagccactattcaaactcagcaggcagtctggcaccagaatctatgttccgaaccactagacgatagcatctgactcaatagaagcatgatcacccaaatcagttcaggattcttggcatcttctgctacttgctgtggcactgaattcaaatatatgttcctgtattcacagaggcaacgtagagatagtgcatatgggaatgaggggttgacggcatccgtgaaaaggattctcagttaagatctaaaatgcatatctgaccagggcactctaactcaaaatcactagacagctcggcaccacctccagaaatacaagtgtctgtggttccctccctgcgaggggtttcatggcttccttgttttttgttcacgctgttccccttttgtcctcttcctcatctaactattacttctctttcaggactgccctccagcatcacctctgccccaggaatcccttcttggtttccccaggctggcttccaggccctttcagtgctccggaatcccttggccacctctgccttcccaccctgggcagaaattatgtctactgcaagcttgtccaacttgtggcccgccggccatgtgtggcccaggacagctttgaatgtggcccaacacaaatctgtaaactgtcttaaaacattatgagattttttttgcaacttttttttttttagctcatcagctatcattagtgttagtttattttatgtgtggccctagacaattcttcttcttctaatgtagcccagggaagccaaaagattagacaccccggtctactgggagaaccctcatgatgttctcaactctgtgcttgttgtatatcggtctacatctcccatccaaatactaaccaggcccgaccctgcttagtttccaagatcagacaagagcggtgtgttaagggtggtatgtctgtaggctaatctttctatctatctgtctgtctatctatctgtctgtctgtctatccatccatccatctatctagtctatcagtcatctatcttctattttctatatgtatctatcttctctcttctttattttccatcttcagaatctggggctgtattcggcctgtatttgggaagctcagtagatgttggttgaactaggtggatgagcattcccagtgactatgatacagggaaatatttactcacagctgatgctgagttaacccactaccttcacttatttcaacccaaatcagaacatatctgcaaacattggggccagatatttgaaatagggacattctaggatattagagcaaatatttcacagatgctttcaaggtccctggtgcaatgctgggtttctgtggatggtgaatttcctggcatctggcttagtactcgttgtagtgcaggtgctcagccggtatgtgctggatgaatgacagagccatgttatacagaaaacgcagtttgacggttgctctctgggactctgttctccaaatcagatggaggagacaactaagtagactcccaaataagccatgcaaatttcccgaatctcccaaactaaacccaaacgttatttttgttttaactgagttaacttttttctttaaaaagacttaagaaagaatgataaaagaaagagaaaaaatcctcctgatccctcctttgcttgaaatcattaggcagctgctcattggaacaaaacaagattttttgaacttgaaactctacatacgtattttttcccttaaggtatcgatgtagaaggaatctgacatttttgaatgttgtccccaaagaaatgaaccatatttgtcattctgaggagcctgctaagaaccctgacaaggactgttagaaaatcagaaccacggccgggcgtggtggctcatgcctgtaatcccagcactttgggaggccaaggcaggcggatcacaaggtcaggagattgagaccatcctggctaacacagtgaaaccccgtctctactaacaacacaaaaaaatcagccgggcgtggtggccagtgcctgtagtcccagctactctggaagccgaggcaggagaatggcgtgaacccgggaggcggagcttgcagtgagccgagattgtgccactgcactccagccgggacgacaaagcgagactccatctcaaaaaaaaaaaaaaaaagaaaagaaaagaaaatcaaaaccattttgctggaactgctgttcccaccttcaccagtcattggtaaaagagaagatccaccttaaaagtggctgtccccatgacgggccattgctagatggacttgacaccttgacctctcgccatctgcaatcagtgaggctcagtaatggtgaccttgatcctggggggataatcatggctgaacactcagtatagttggaactgggcagaaaacttggcctaggatctagacactctgaattatttcatttttctttgccttggatatctgagagccccagaaagagaaacaggctctctaaagcagtgtcaggagatttggacacaggctcagtcctgacattcatttgctatatgatcctgcaatagtcgctcaactcttctgggtttcagctcctctatctataaaatgagatggtcagattagacaggtggctttcagttttttcttttaaagcaattaacctctttttgaaaaaataaaattatagccagtgtcccagtatatagaacagataaaagtaaggccactccaccctgtcccgcctccaccataaacttgactcatcctgcagaggtggaggtgcacagtctgagaaccactgaactagaaatgacagcaacaacaacaaaaatgaatctttactgaatgctcttctgttctacacagggagtccctgcagggaggaagacggttgtgcctgcaattctaaatcttaccagaggcaaagtgaagtgttgtaatagagaaccaatgtctggagccagactgcttggtttccatcctgacactcctgcttgctagctgtgtgaggctgagcaagttttctaacatctctgtgcctcagtttccttaacttcaaaacgaggatgatgacggtcccaccatcatagggatgttgtgaggatggaacagagttattatatctaatgtgtttaaagtctgccgaatacacagtctgcgtggtggatatgtcaggtattatcattaatttccaccttctccctgggtttttggttttgttgtttgcttttctttttcaacttgtcttttagattcaaggggcacatgtgcagctttgttacctgggcgtattgcatgatgctgggatgttgggatatgaatgatcctgtcactcaggtactgagcatagtacccaacagttaggttttctttttttctttttctttttttttttttttttttttttttgagacagggtctcattctgtcgcccagactggagtgcagtggcacgatgccagctcactgcaacttctgcttccaaggcttaagcgactctcctgcctcagcctcttgagtagctgggattacaggcatgtgccaccatgcccagctaatttctgtatttttagtagagatgggggtttcaccatgttggcgaggctggtctcgaactcccaacctcaaatgatccacccgccttggcctcccaaagtgctaggattacaggcatgagccaccgcgcccagcaacagttagcttttcaacccttgtttcccttccttccctcttccctttagtagttcagtgactattgttgtcatctttatgtccgtgagtacttcatgttaggtcccattcataagtgagaacatgcattgtttggtttactgttctgcattaacttccttgggataaaagcctccagctgcatctatgttgctgcataggacatgattttgttctttttaatggctgcatagtattccatggtgtgtgcgaaccacatttcctttatccaggtcactcttggtgggtgtctatgtgattccataactttgttactgtgaatagtgctgcaatgaacacgtgagtgcatgcgtctttttggtagaatgatttgtttccttttggatatatatccagtaatggctgggttgaatggtagttctgttttaagttctttgagaaattttcaaactactttccagagtggctgaattaatttacattcccacagacagtgtataaacattcccttttctctgcagcctcaccaacatctgttgttttttgactttttgataacagccattctgaccgatgtgagatggtatctcatggcggttttgatttgcatttctctgatgattagtgatgatgagcagtttttcatatgtttgttggcctcttgtatgtcttcttttgagaagcatctgttaatgtcttttgacaatttttttaaatggggctatcggttttttggttgttcaattgtttaaattctgtatagattccacatattagacctttgtcagatgcatagtttgtgaatattttctcccattctgtaagttgtctgtttactctgctgattgtttatttagctgtgcagaagttctttagtttaattaggtcccacttgtcaatttttgtttttgttgcaattgctttttaggacttactcataaactctttcccaaggcctgtgtttagaatggtgtttcctaggttttcttctaggatcatatagtttgaggtcttacattgaaatctttttttttgagacagagtctcactctgtggcccaggctggagtgcagtggcgcgatctcagctcactgcaagctccgtctcctgggttcatgccattctcctgcctcagcctcccaagtagctgggactacaggcgcccgccaccaccccggctaatttttttgtatttttagtagagacggggtttcaccgtgttagccagaatggtctcgatctcctgacctcctgatccacccgcctcggcctcccaaagtgctgggattacaggcatgagccaccacgcctggcccattttggttaatttttttacatggtgaaaggtaggagtccagtttcattcttctgtatatgactagccagctatcccagtatcatttagtgaataagggagtcctttccccattgcttatttttggcaactttgtcaaagattagatggctgtaggtgtgcagctttattcctgagttctctattctgttccattggtctatgtgtctgttttgtaccagtaccatactgttttggttacggtagcctcttttgcttctttcatgtttgtgaattaagttccttttctttttttgagacacgttcttactctgttgcccaggatggaatgtagtagtgtgatcatggctcagtggtgctatcatagctcactgcagcctcgatctcctggctcaagtgatataccatctcagtctccctagtagctgggactataggtgccaccacagctggctaacttttaaatatttgttttgtaaaggcagggtcttgctgtgtttcccaggctggtctcaaactcctggcctcaaggaatcctcccaccttggcctcccaaagtgcctggattacaggtgtgagccaccatgtcccttttccttggatgagtgctgttgtcagaatctgtggtttagcactgaattggatgacactttgtgtggctattggatgttataaagtcctatcctcttcccatttgatcctgatccaattcttcagtctcatgctcttgctgccactcctttcttcaatccatatgttctagaactgcaaaactgttctctccacaaacacacaggccactcttgcctatttacctttgcacctgctttcctccaactgaaatgctttttctctcctccctctgcctggtgaaggactatactgtcttcaagtctccactgaggcctcacctcctccaggaagccttccttggtaccccacaaatcacgctggctgcctcctctgcccatactcccaggaatgaacctctattgtagcatttatcccatgcctctctgctagattgtaagctccttggaggcagggactgtgccttgtttattgtgtactcagaatcgaccaaagtgctggcacaagatggctgtttagaaagggttgatgaattaatgagacattattaatctcatttagatcaaattctccttgagagatgactttaagctcctaggccagcggtttttaaactgtgttcttcagagaactaggggttccactaagaagctgcaggagtaccactggggtggagtaggggctaagcagacaggactccagccccagctcctcacagtcttcataaatctattcatatttggccgggtgcggtggctcacgcctgtaatcccagcactttgggtggccgaggtgggcgggtcacaaggtcaggagatcgagaccatcctggctgacatggtgaaaccccatctctactaaaaatacaaaaaaattagccgggcgtggtggcgggcgcctgtagtcccagctactccggaagctgaggtgagagaatggcgtgaacctgggaggcagagattgcagtgagcggagatcgtgtcactgcactccagcctgggcgacagagcaagactctgtctcggaaaaaaaaaaatctattcatatttgtcagatcacttggattcatctttgatttagaaacagagtcacaggggtattataaataagcatcgggcttcaagtcagaaggctctggtttgctacgtagcttaagctgggtgtgcctgggcattcgcccaggtctctgcctctgcagcaaaacgggggtgaccaaaccagccccacagattgattatgaagagtaaatgtggtcccatggcatcatcatatatgagaaacacctcaatacattgagcacgaacgtcaacaatggtgattaaattacaggcagtcaggcagggctggcctctttctgacttgtgatctgaaccgtggagctcacgtgttcagaatgaacatcacctcactggagttcaaggctctgcaactcgtacgtgcttcagaatccctgggaagctaaacgttaagatgtgagttctggggccgggcgcggtggttcatgcctgtaatcccagcactttgggaggctgaggcaggcggatcatgaggtcaggagatcgagaccattctggctaacacggtgaaaccctgtctctactaaaaatacaaaaaattagctgggcgtggtggcgggcgcctgtagtcccagctactcgggaggctgaggcaggagaatgttgtgaacccgggaggcagagtttgcagtgagccgagatggtgccactgcactccagcctgggcgacagagcaagactccatctcaaaaaaaaaaaaaaaaaaaaaaattgcctagggctgttggggtgtgggaggagggaaggggaatgactgcttaatgagtatgatgtttctcgctggggagaggaaaatggtctaaaattgaaggtggtaatggttgcacatatctgcgaatatactaaaagccacttaatactacacttaaagtgggtaaattgtattgtaagtgacttatatctcaataaagctgatattaagaaaacgaaaaagtgcttcctgagaaattgggggacctcattgtttgagaaacccttttcaggggtacagattgcccctccccagcctccaaagatggaaactcccatatttctagagcatttcctctggcaatcctcacactgtgctggttaagtttccggttaaggcccgggtgcggtgggtcacatctgaaatcccagcactttgggaggcagcggcaggtgaatcacctgaggtcaggagtttgagaccagcctggtcaatgtggggaaaccctgtctctactaaaaatacaaaaattagccaggcgtggtgcaagcgcctgtaatcccagctcctcgggaggctgaggcaggagaatcgcttgaacctgggagacggaggttgcagtgagccgagatcatgccactgcactccagccttgggtgacagagcaggactccatttaaaaaaaataataataataaagaagtttctggttaaggattccaaccattttctagaagggcaatccaaatcacaagactgtgaaaggacttaagccacactcagtgtcctaccccaaacttttttattttgattttgattttttatctttttattttatttttttaattgagatggagtcttgctctgtcgcccaggctggagtgcagtggcgcaatcgcggctcactgcaagctccgcctcctgggttcacgctattctcctgcctcagcctctccgagtagctgggactacaggcgcccccaccacgcctggctaattttttgtatttttagtcgagatggggtttcaccgtggtctcgatctcctgacctcgtgatccgcccgcctcggcctcccaaagtgctgggattacaagcgtgagccaccgtacccggccttatttttatttttgagatgggggtctcactatgttgcccaggctgtctcgaactcctaagctcaaatgatcctcccaccttggcctctcaaatactgggattacaggcttgagccactgtgcttggccctatcccaaactttttgatcaggccccctatcaaaaaaaggtgaggatgcatctcaatatatgatgagttatttgttttttaaatctacctaaaagttatacttgtattaatatgctgatccatatggacattataaaatgtgcacacaatttacacttaaaaagatgagcttataaaagtgatagggaaaccttttttgaggaagttatttgtttgtttgttttttgtttttgttttttgagatggaatctcactctgtcactcaggccggagtgcaatgatgtgatctcagctcactacaacctctgcctcccagattcagcaattctcctgcctcagcccctcctgagtaggtgggattacaggtgcacgccaccatgcccggctaatttttgtatttttagtagagatggggtttcaccatgttggccaagctggtcttgaactcctgaccttgtgacccacccacctcggcctgccaaagtgctgggattacaggcgtgagccactgcgccccaccaagggggtgagatttgagcagggatgtgaaggatgtttatcttcacactttgcgttgccacctaatctcgccccacaggggtcaacttaagccttctgccaaaagcccagagagtccttgaaatcactgtaagagatctctaagaataatgagagggcaaattagaaatggtgggggggcggggggggcagaacagacccataaaggaaaagataaatgaagaacagaggagggaaaaaagagttatagtagaaataaatcagaagaccccatgttcaaatctcaatatttcaaacctctaatattttatgattggtatgaatttgaccttgagtttagccttctcatttgtaaaatggaggtaacaatacttctcctataggacagttcagagcatttactgagaggatgtgcttaaagaaagagacaaggggccgggcgcggtggctcacacctgtaatcccaacactttgggaggccgaggcgggtggatcacaaggtcaggagttcaagaccagcctggccaacatgaagaaaccacgtctctactaaaaatacaaaaaattagctgggcacctgtaatcccagctacttggaggctgaggcaggagaatcgcttgaacccaggaggtggaggttgtagtgagccgagatctcaccactgtactccagcctgggcaagcgagactctgcctcaaaaaaaaaaaaaaaaaaaaaaaaaaaaagcgacaagactgactgatgatgggagaaaggaactattcagggagggagatgggagacagagtgcagtttcacaaacatatactgaatacccactgagtgccagaaactgtgctaggcaggacatacaaaatggaatttgaccccattgctaccctttggggagcctgaagtttagcagggagacgagacatataagcagatagtcaaccgtacattcagggttggaggctggcagtggaggggaggggtatgaggtggggaagaggaagagggaggtgctctccaccagtccctgaaggcacactgaggataaagatcctccttctaggtggcaggtggcagctgtcctgccacgtgagtgtcaggggccctgggaatgccttttcagcatgccctggctccacgcaaccctcccaaataaacgccttccagcccagacaagcaggaagtgtgctgggctggcggatggactgacgctcgcacatgcaggcacatgcacaggaaactgaactgctgggcaggttattttcgtttttccctttccaccaccactggagcaatcagtgacattcctttccctcctaaacacacaggtttgtgtaccagagcctggcaggaagtgaagaaatcccctttggaagagcagcagcggcctctatcccgtggcctcctccctcattcctggggtggctgcctggggcctcccagtgctgtggccttggtggcttttctcctctttttctgactgttccgggaaaggggagggatgggggagaacctggttcagacctctttttggaatcacagtgcctttggccctccactgcctagctctctccagcctcagctcagttcttagaatgatgtcgtagcaggaagtggttggggaaagggtggtgagaggtggcagacacaggaggagagaagaggttcccaggtccgagagaaaacaccagaggggagaatccagagaggactcagaggtgaaactgtgccttttgacagtgacattccttccttcaaaacacttttcctaagaaaattaagaaggcaaggacaagggacccagaatcctccctaaagccagacaataattaaatgagagctaagggccgaggagggcagatcacctgaggtcgggagttcgagaccagcctgaccaacatggagaaaccccgtctctactacaaatacaaaattagccgggcatggtggcgcatgcctgtaatcccagctacttgggaggctgaggcaggagaatcacttgaacccgggaggcagaggtggcggtgagcgaagatcgcaccactgcactccagcctgggcaacaagagcgaaactccgtctgaaaaaaaaaaaaagctaagggcccaggaatggcagaaaaatacctccttgcatcttaaacttgtctgctttaataatttactctacaagtaatacgtgctttcgtgtgtgtttaaagcttgtgaggctggatgatatttctgaaacgttaattggtaattgtttccacctggtatgtcctttctcttgagacccttctccatttgagccagtgggctgctctgtggctactgctttgggaaagggacgtaactgctccctgccctctgcttttgtttccaaaacccaagttcttaggaaaaccaaaacaactcttggcataggagacaacagatttgggagaaatacggtatgtaagagcagggcttctcacctctgagatgagacaagaattccctgtctgggggaaaggggaaaagtggaggtaaatccacaaaaggggatattttgggggttggggtggggtggggagctgtaccccacttctggcacgtgagccttggaataaggaacaagtcccaaggagattcaggcaaggaggggacctgcacattacttcctggtagaactatgtcactggagaagcagcaggaccctagagtggaagtggctgcttgaaacgtccaggtggatggagccgcggaaagggtgcctactgaggtatgagaatagcaggaagattcccgtgcatccaggaagagcacagagcagtggagatgcatggaatggatccctggctcaacagcaacctgtgtggaccatcagctgagcacctagtgatggacatctccatgaatgccatttggatcaataacattggtgtttcctcccactgtcttggaactaactcaagctccaaaagtctggcgcaactctaggagaaggggagggaaccccaaactgacttttgttcatgctggtgcttaaaatagaaaatgaaccttagaaaaatccacttacatttcttgcatctgagtccccctgggaaggtggatggagaacctgactcataaggtcgcttatttagtgttggcagtttccataaatatttacacctgagttttaaacatccggctagcgcttctttgtgctagatctttttttggggtaatagagggataaagaaggagcagatgtgttataataggtgctccaagaagattgcaaatacagcgttatgggagcaggaggatgttgagaaagtctttccaggccctgcaaactatgagtaagggttttctcgggtttgagtcaaggattgaggcacttctgatttgactggctttgtgagcagagactgagaaacaatgaaacagtggaaagaatggaggcagatattgcagaaatacaagaatagcaaatggcaaggccccctctccctctgtggttctgttttggatgagatattccagatggagcagctgaagtgagtggagacctgtttggcttgtggaagaggttttggttctgtatggagagtaaaaagccatcaggttaagagacaagggctggctcccctgaagccccctgccttcgctggttgctgggaaccaagtgaaactctcttgaacttgagtcagcttgaatacaggtctgtgtgtccctgtaactgccaaaggcttgggggcttgtctggtcacctgttttatgtgtctgggttttacctctcctacttatattctatgtcatgagaaaactggcctttggtcttggaagacaccacccagaatgcccctctgcatgtctatgagttccaaatccaagggggtcagcagaggagggacccagggatctccagaaggcctcttggtgttcttttctcggagcctactgtgggctcctcttccaaggctacaggcatatgaggtagggacagagatcctggtggcatctgagatgatgtttggtgatgcttgaaaatagcatcaacagactgaatcatatgctgagaaagttatttccttttcagtgaattttctagctttgagatttttctttttctttttttttttttgagacagggtctcactctatagcccaggctggagtgcagcggtatgatcatggctcactgcagccttggcctcctgagttcaagtgaccctcctgcctcagactcctgagtagctaggactacagatgtgtgccactgttcccagctatttatttatttattgagatggagtcttgctctgttgcccaggctggagtgcagtggcgtgatctcagctcactgaaacctccgcctcctgggttcaagcaattcttctgcctcagcctccggagtagctgggattacaggtgcgcgccaccatatctggctaatttttgtattcttagtagagacagggttccatcatattggccaggctggtctcgaactcctgaccttgcaatccgcccacctcggcctcccaaagtgctgggattacatatttttaatatttttttacattttttttgtttttggtagagatggagtctcactatcttgtccaggcttatcttgaactcctaggcacaagtgatcctctcacttcagtctcccaagtagctgagactacagacacacttttagaaaagtttttgtagggattgggggggtgtctcaccacattgcctagactggtctcaaactcctggcctcaagcagtcctgcacacttcagcttcccaaattgctgggattacaggagccgctacacctggcttagcttttgagactctattaaggagagtcttagtttggttcctgtgctctttcaacacctccccaatattagcaaacctcccactttcctggagagcttggagcccatagcaagcaagagtatccagcatgaattcaataatattgctttgttcttgtgttttttatggttattttcttttgtcaggagatactggttttccatttatggtagtcatcagtttctttgaaaataggtttattgaagataaaacttaaaaatatcaataattatatgaattacagtatacacagtacataaatatggtaaaaattgtaaaggttgtgaccaacgattgaagtttgggaaacccggacttaaagttttggccccagtgaaaatcctgcccttagtagtttaatggaaagagcacagcattggttagaaatatctgcatttgagacttggcattgtaaagccctgtttggcacatattagctacatgaccatgggcaggttgattaacctctcaaagcctcagtttcattagctgtaaaatgggaacgtactacctcttgaggttgctgaaagattaaatgacatcacacacacagagtatacgctgagctcagagcctggctcacagcaaacaactaagatggacaattatgatttttgttgttgtccaagaagcacctcttttactctgaggtgccacacaacagtcattggccactcataccaatgaatgtgcattttacattttctccctgcagggagtttggatgggcacaaagtaaaacaaagaggcccctggatgtgaaggagtgtatgaaattaggaaacaagtatctcctgaccacctattacagttgattgtatcatcgttcctaattcttcacccctctctgtatcaatacctgttgtcaggtgacttgatagtttcttccactagaggcggagtatacttcccctatccctaattctgggcttggtcatgtcgcttattttggccaatgggctggtagcaaacgtgacacaaacagtggcttaaaatgtgcttgtgaatttgggtatgaccctcttgtactgctgcagttagccatgtcctggctagcttgctggtccactcagcgccaggcctagagcagccaattcccatctgacctgtgagagcaagaataattattttttaagccgccgagctttgggatggtttattatgtttcaaaattgtgacaatagatgttaatgacccctagtatgtaccgagtacaggcattttcgtatagtctatttaatttcatcttcaaacatccccatttactaatgaggaaattgagactttgagaaagccctcctggtccaagatcacacagaaaggaaacagctgagcttggaggcaaccctgttccaactcccagaacatgctcttcttactacaccacggaagaatggggtggtgggaggcggaacacaacaaaactagcttcgcggctgggcccaaggctggtcccatctagagtcatctttgagaccacaagagccaacatcataaatctagaattgtgacaacacaggatgactcaggcagggggtggccggacagggaagccctggtgaggggctggttggttataaaacctcagtctaaatagggacagggcggtaacattagtagacagggctgggccacagaatcgggtggtttaggacaaataatgacttgaaatttattttggaaaatattttcccaagtgtctcactgggccttgtgggaatgagaaaatcagtggggaaaaagccaggagaaaaagctgatgaggctgagaaggggctcatgactagtaggctttgatttcataaaattcagagcattagatgttcctggaggtgaactcttactcatgctatagaactcttcccccaattcccccgctctgtgagttatcccatcataagacagacgcaatctcaaatttctctattcattctccaacagttatgacaacggccagcattcattgagcatgtactaattgccagacactattctaagctctttacacttttctttctctctctctctctctccctccctccctccctccctccctccctctctctctctctctctttctttttgagacagagtctcactctatcacccaggctggagtgcagtggagcgatcacagttcactgcaacctctgcctcccagactcaagcaatccttccacctcagcctcccgagtagctggtaccacaggtgtgtacctccatgcctggctaatttttgcatttttgtggagacggagtttcaccatgttgccccggctggtctcaaactcctgggctcaagcgatcccctcatttcagcctcccaaagtgctgggatggcaggccactctacctggctgcactttacacttttattggtcctttcaatcttcacaataatgctaagcagaatatgctcctactctttcccattacacaaatgaaggagaaaaacagaggcccagagatatgaactacaaagcccaggctcacacagctggtcagaggcagggttggaactctaatttgagagagtatgctctgactcactatgccgcgtgtttactgtacagcgctgtgacaatctgagtctcttattaaatgagataatgcatgccaagcacttagcttcttgcccagcattagagacggccaaaaatattacaataccaagtattcttatgctgatatgaattttattttattaccttataacagctgcttccccagtcctccttagagaggaaagtctttgtggggaacatacttagcgactggaatagaaggtcagtcacttgagggtctggggtcagctgcagccaagtcctcatgggtgggagggactggggagaagaaattggagatcttggccaactgtgaggggtctgaggagtagagatggaagagcacagaaggccaagaagacagacaagggctctgtattgtgagataagactcccttcttgggacctcactaaggaggtcagtgagtctactaaacacactgctcttggtaggagacattttcgcttgtggcgggagaaagagaagccactgaacttgatgccagcattgatgtgtgtggggtgatggccatgggggagtcagtgccccagaggaagttcagaagaagatgagcccaccagtgattagcaagaatctgagaaaggccagggaattttccttgagttaggaggtctccagctggcctctgggtagggttgttattttcgatggtgtggctaacattcttgcccctctccatgatatgcatgtttctggagcacacaggtggggcatgatcgctcctctggctcccccagggccagctcagtgagaagtcaggaagccttggatgcatgcttgaatgaatgaatgaatgaatgaaaaggctttaaactgaggatggcccatgcttgctcagatatacatcaactcagccacgcgtgataccccatcatcagaggatgctttagacatctcagttcgccatgttcctaacctacaccctgcttcccaaactgctactgatgctgcaaccaactccatctctgggttgatccctcagatttacattaggggatggtgacatatgggcctcgtggctgccctttcctcctcctcacttgggctgacattagagcagtgtggttccaccatgagccaatgtgtggagacattcttggttttcacaatgaggggaattgctactggcatctagcgggtagaagccagggatgcatctaatcctagaatgcacaggctagcctcctgcaacaaagaattagcctatccaaaacgttaatagtgccagagttgagaggctctgcattagagtgtcatggttcagagcacactcactggaatttaagaggactggtttgattccagactctgccacttaggttgagacagagatgataattgtatttacccgtagggtcatcaaaataattaaattgggtctatcaacaaccaacttctgccatctcctccccgctagtccccaccaaaatgcacacactcaatttagaacagccggccagatttcaccatggcccaggaacagaactcgtatgggttctcaggcccagcaggttctttgttccacgagccatgacatgcttcagtccttccacgctaagggcatctttcccacacctaagtctgcgatgcaagtttttttttttttggaaaaaaaaaagttttcttttttggaagaaaacaaagaaacaaagtttctttgttggaaatggctaattgttttgctttcatcgtctcaactggggagttgggtttgaggtaacaaagttgtgaatgcaaatggttatatgcaactaggcaaatcagatttatataaaaatctaattttactaaagggaacactttctggtagggggtgggggaccagcagctcaattctatgaagcagaaggtcagttcctcggaatttatgctataaaaacttaatgcacatccacagaatgtcagaggaagtgatgtcagagaccattttgtcaaaccccctttgagaaattgacgcccaaagggaggggaaacttcctcagggtcactccctagttagcggcagagaggagatcagaaccgagaggtcctgacgccctgtccaggctggctccaccccacagaattgcctctccctaagggaaatccctatgagcttaggtgtcgaggaaaagatgacttctccctacgttttcagttcaaacctcacagtcaataagaatttaatgttcagaatcatctcttgcaatggggctttcattgcacgtgtttttttcttctcttggcctagaggcaatattaaagtaattccctctgtgggtgctttgctccatatgtaaacacatgtctaccatctatacacaggcacatgcatttgtcatttcttcccagaatgacttaatgatttccatgtaacgaatatgttgcagctgttggttttcttgaggctgaagcactcagaaaatcatcagttatcaaattgctttcccatcactgtttttcccaaactggacaaattttctccccctttccttaaaagaaaaaaaaaaaaaggtatgatgggccaagatgatgccccttaggctttagaattttttatcaatggcaaaatcacggctaaaatatccctatcagttattttctgaagttgatgtctgccttacctttaaaaacaaaggcttgtgctgccaatgaaaaatgaaacaaacaaaaaaggtttacaagaaaagcatgaaaaggaggttagaaaacaaggtaagaaaaaaatgctagggcttcatttccagccaaacccagagtcctttatgggaggggctgcagggaccaggctcatggtgtatttttggggaagcttctttggaggagaattttagtttgctcacacatggcagccagcttccagtcagaagatgcaggaggtgaaaagttgggggtcaggaggtaggaagtggctctggggaagacagtgtgttgagttaacgggatcaggaagactcgggtccaaattctcatagccatttagtagctttgtaactttgagaaaatggttcaacttctctgaatctcaatttttaaactccacatacagagccttttctcattgggtactgaggattagaatgaatgcccaataaaggtatctcctctctctccctgcttcctttccagccttttgaagtctgaactctggctgacagaacgtaagaggtaggtgtgttctgtgaacacgtgccactgcaccattagttcctgcctggccttgaccccaacacgttctctgcttacctggaccagggacagaagaagatcttcctgctataatgccagggcccagtacccacactgggggcctgtggtgcccaaggtgtctccagccaggcctatgcctgagagttaagagaggacacagcaacaaggtaagtcggcccagagcagcctggacctgccaggttgcctaaagccctttttgtctgtttcatttcctccatcccaccctgacacccactcccctccctccactttctcagttccttggtcctggcagtttttcttgtctggactgtactactactctcaactccagcctgctcactctgccacatgtgtcttctcaaagcctggctccagtcatacctgattgtaaaacataaatctgtcaatggcgacctcctcaagtgatcccccaaatcaagttccttggctctgcctccaaagcctcctgtggtctggccccagccttatcttctgctggtccttttcctgtcccctacatgccacccagacgggacagcttgtcccctgcctacgtggctcagagcctttgccctggctgggtcactcttggaggtacttctgtctctctccacaccgagatctcattcatgtccatatccagctcagagaccctcacagaagtgtgaaccctactgtgaactgcacatgcaagggaactaggttgaacgctccttatgagaatgtaatgtctgatgatctgtcattgtctcccatgcatgcttcccagcatgcctgcctagccccattccacgtgttcggcagccatttgctgctgctactctgggctggggccaggctccaccccttgatattctaggtgcttgtccctttctctcctgacatttaccatgttctatgtccttttgtagttacttgtgtatatgtcacatttcttctactgttgtcagctcttctagagcaggaaaggaagcctcatgcattttcccctaagctacagggcaagcatagaataatggaagaaattaagacttgaaatcacatgacctgggctcaaagctgctatggtttgaatggatgtgtccctccaaatttatatgttgtagcttaaaccccaaggtgatggtatgaagagatggggcctttgggaggcttcagagagctgcttggctcttccatgtctcatgctatgtgaagacacagtgttcatttcttttatgccacttctgctgcatggtgacagagcaagaagtaccctctttgaggcagagcgtcctcaccagacactgaacctgttagcaccttgaacttggacttcccagcctccagaactatgaaatacatttctattctttataaatgacccagtctgaggtattttgtcacagcagcaggaatggactaagacaggggtctccaaccccttggccacagactgtggccttggtaccaatctgtgacctgttaggaattgggccgcacagcaggaggtgagcagcaggtgagccagtgaagcttcatctgtatttatagcccatttataccccattgctcgtattaccgcccgcactctgcctcctgttagatcagtagcggcattagattctcataggagcgtggaccctattgtgaaccatgcatgcaagggatctaggttgcatgcttcttatgagaatctaatgtctgatgatctgtcattgtctcccatcacccccagatgggaccgtctagctgcaggaaaacaagctcagggctcccactgattctacattagggtgagttgtataattatttcattgcatattgtgatgtaataataacagaaataaggtgcacaataaatgtaatgtgcttgagtcatcctgaaaccatccctccccatccctggtcagtggaaaaattgtcttccacaaaactagtccctggtgccaaaaaggttgggagtcgctggactaagacaaaaccccagcttcaccacttcatgaccattggagaactaatctccctaagcccagttacccactctacttgtaaaacaggggtgcaggattattgtgaaaatgagaggatatggtctctgggaatgcctgctgtgtggtagatgcacaaaaaccagtaagtgtccttcctttagcaaggggttttgaacggctcataatactaccgtctactgtttcacaagtatatccttccattctgcaaatttctgcagggcaggcctcatgtcccctttcagcacagtggttatgagtcaaacatgttgagctccatttctccatttctgactctctcacttacttgctgcttgaccctaggctaaagaagcctcagtttgctcatccataaattgggaaaaataacataatctaccttacagactgttgaaaggattaagcgacatgatgtatatcaagtgcttggttcgtggtaaatctcaacaaatatgagctgctgtatcaggatagtgcttttgaaacatgatgcagaaagagctctcctttgcatctccttggatggaaacttacccagcatgtgcttgtcttggggaggttgaggtttgaggtgttagcaaagcagagtggtagcggatcgatagtcaatgtttaacattcagagtaggactttttgagtctgtaaaaggagtcttgtcttaagcaaaatcagaatttctaaattattttagctgctattgacttagagggagcaggacatagttttttgttgttgttgttttgtttttttgtttgttttttcttttactggatagagcagctacctcttctattcaggctgagcaagaggctgaatgcccgtaggaggaagacgggatgtagggacgtccataccagagacaacaaagaagaaagcttttcactgcagggcattgtgggagggagacagggagagaggggaagagaagtgagaagcccctgtgtccatgaggtctctgagctgaagcattagctaagggcaccttgttgggtggagaagaaagctggcaaggtgggtggggagcttctgccccattctggcttggaattctgggaagagatcccctcccaggcatccccctccctacctactcagcatcagtctcagcctgagagactctgcatttgccctcctgagccaccctcacttctcttttcttttttttctttttgagacggagtcttgctctgtcacccaggctggagtgcagtggcgcgatcttggctcactgcgagctccacctcccgggttcacgccattctcctgtctcagcctcctgagtagctgggactacaggcacctgccacctcacccggctgattttttgtatttttagtagagacggggtttcaccatgttagccaggatggtctcgatctactgacattgtgatccaccctcctcagcctcccaaagtgctgggattataggcgtgagccaccgcgcccggcccgagccaccctcacttcttgtctgacatggaagggaaccagaggctcccataagccactgagagagacacagaagttagctgagactcagacaggggtgctggccaaggaaggttgttgccccagggccaaatggccttcaaccaggggctactcgcattcaggctgcccgggcagagcagagtgggggtggcatcattctgagaacaaggcagggcttggtaagaagggctgcagactgtgctctccggagccttccctatgctcaaaggacacagcagtcatgaactgggctccagtgtcactcatcagctgaatgcttgggacaggatcaggccagcccctcctcaatgcatgccagccaggcacaaccaaagtgcagacctacagccccccagtggagaatggccaaggaccatgtcagaagaccttcaccctctctccccttgccaccctaagtctctggcattgtgctggcaccttcaacaaacacttctctttcccctcctgtcttcctaggacagtgtttgcatcttactcatcctgaatctccctcagtgccctgcagagagtaagtgcctcacacagtgcttgatgagtggatgaaggtagccttgttaaagcctctgggatggatttgaggacgttaaagcatgctgagggggaggagagagaaaaaaggagggtgggccgggagtcgggaggagacctctccattcttacggtgaacaggccaagtgaggcagaaggagaataaaggcagagcctagggtgagggcaggggggctgcagacacccctagagcccaggagaaaccaaaggaaggtggtcggtgacgagcaggtgggagatccctgggtaggctgtgctggcagcaccctgtgctcatagctggtgtttgacttcccccaaccccgctttcgggtggatgggtgagagaagcaagtgtggcccagcaggctgcagagtgagctggtgtctgtgagaggcaggggtcctcctggagactgggccttgggtcagcgagggacatgctgaccctgccttggcaggttagaagctggacagccaacagcccttccatgatggcaaaaatacacatctctcacgctcattgaaggctttgcaatttacacaggctacaggatgactgtggagtcgcccatcccatccataaggcatttcaggcaggtaccatgatcaacagatgctattacacccccatttgatgagtaaggatgttcgtggtgacaatgggatttagggtgaacatggggtcgggatgtgtacaaagatgagggtgcacttaacttcccctactgctaaaaaagggacgttgagctggagcttgaagaatgagctgttgtccatctgagggagaaggcagagaaaggacatttcaggcacagtgaacatgtgtgaaaggatgggggcgtgaggaagcatgttatatgtagcgataataacaggaatgattgctaacatacattgcgagcataccacatgacaggcgctattcggacttcacatactgaactcaaatccattctcacgacagcccagtctggtagatgctagcatgaactccattttatagatgaggaaatgaaggcacagggaattaagtgatttccttaaggtcacaatgagagcaagtggtgaagccaggactggaacctacttgagggacaggcgtcctaacagtgtaaccaaggtgagtaagggctaagcaggaagggatgaagtatgtagctaaagagttggagtggggtgatgataagggaagatatttagattttatctaagaagcaatagggagccattgatggtctaagcagaagagtgttagaaaggtccatgtggcacaggaaagagggaaaattgagagagagaatgaagccacgaagagtgtgctggggagacagccagatcctttattgttacatgtaagccagattgcttcttccatctgggtaaccatcacccactctggagctcaacttcagaacatgggttatactatttcacaaactcttcctgggagacaagagctccacctggacctgtgacatgactggtacctcccacatcacattctgtgcacccagtaactgcatttggctctgttttccttggattgctagacattctttacctctttatttaatgcactaggtggtgttccttttcaccctaggagcacaggatagtattagagtccttgaaaaggtgtttcagatattcttagtgggaagctcttccactgggtgtgaccctggacaaatgcctcctccatactttttttgctgcctgtcttgtttctcatatatacatgggcaggcaacctggattctgccaggcaaccaggtggcaagttggcccgcccaccagtcccagttctaaagagtggctgtgtgactttggtgaagtcactgtgtctccctgggatgcatctgagaggaaggaggctgtactagacaatacaggcaatacctaaactgtcctccagcaaatcatgtttgctgtttccagaatctttacttccgagagtctaattttattcaatggttcaatgtatatttgtagagtcaggcatggtgctagggatatggtggtgcaagatagaaagaacccttgctatcattctcactgatcatattcagtaactgatcccattgaacatccatgcattgagcacccattacctcctggatctgctgctagaggctatgagaggcatagagaagatgaagatatggtgcctgctctaaactagcttttcctccaagttcacctccttaaagggagacagccagctgaatgtggtcaggaggactccttaaaaggcgctccttttgctcatcacctgtaacttcagtcaaataagtagccgtgccaaacctggtttctttggggcatggcttccaggtcagtgcgtctctgacacttgccccaggtgcagcaaagttgcgaaatggacacggctccgtgtgcccaccagatggcggcattctagcatattccctaacagctggggtcattgagaaacagcaccctgtgttggtggagggaagagaccacttcctctctaatccagggcccattcatactgatcttctggaaagttctggggttaaggggctggcggggaaggaatggtggtcgggcaaaggaaaatggcgctaaatgctccatccaacaaacatttctggctgccttctggagctccccttgtccccaagtctgcatttggtgataaatttgcatcattacttatttacctgtcattctcttttgtccagttggcgccatgtctatttcctcttgggatccatggtgcctacgcagagtctggcccagagcaaggattaagggtcttggccgaaaaaaagtgaagcttattttaagcaagaacttaaaacagactctcacctaaggaccaccacccaggcgagggcttcttgggccattaacatccttgacctcaaagatggaaattgcaagatgggagactgagagtgccgttcaaggttccctaatgtgagccattggagacatggctgggatcaactttaacctatctctgctcaaaaggtgtcaaccttgtccacatcagccaggatgtcaaggtggagaggatagaaattccggatctggctgagtctagtgcccaccagagaaaactttggcctttaatctgggatttttacatcattttcttctctaacagagggagagagaggggcatgagttgggtccaccaattgggacaagcaggtccaacctgcttctctgctgtcttcaattccattcagacccctacgccctgctgcctagcacctccaccttcccctctggggctccagcaaagaggaaggcagtcagaaccactccaaagggtccaatctccttgcattccagccctggccaaagtcagcccgggaacaagtggagagcccctcttgaaggaagtgattcagaaaccatgatggcctggcggcccgccgtgactcacagcacatcaatgggggaattgtctgtagaagccgagaattccaaagctcttttctttcctttcttacttactttcttttttttctttctttctttcttttttgccctccccttggcggcattgtgcaacagcagggctgcccagaaacatgtggttttcatcattggctccacagctgccctagagcactgtggagaaaataagatggagagggaacaggatacaaggggacctgtcgcggtcaagcagggtccttctctttccccccacctttcttgtcaacaccaacatcctcaaagagcatctggaacggaagggaatagaattttggatctgggagaaaacttagagtatgtctcatccaataactctatgtacagatgaggaaactgaggcctcaagaggggacgtaagtggcttggcaaatgtccacagccaagttgcatcttgcatcttgctgcagtgactgacttttcttagcctccaagtcaggaaatgtagtttgacaaaggataatttttttccatggaatgtgacagatgaaaagtcataccaagtttagttataaatctctccattgtccctttccccttatctaccagtctagggagtctgttttacccggagtcatctgtggggacacgtgcaaaatctaaaggtctttttgcagttgtcatctgattggtcatctctgtagcatgtgaattaatgtccacaggtttccaggtattccccctatgcatccactcctacctctgcaacgtctccttttcggcattcttttctcctcccttggctctcagatgccttagttctatagggctgtcttatcttaactcatatccatgttcacggtttcagtggctatcattcagctgaggactcccaaatcttatctatagtctgttcatcattcctgagctacagacgtgtacatacagctgccttctcagtgcctttcttggattccccagatggaactcatcatttccctccatagctctttgactactttgattttattaccaagtaactatgggaccaatatagtcagtgttccaaagcacatgctttggcatcttattgacctgggcctgactcccagatatgccacttaactggctacgggtctttggccaagttactgacctttccaagttcctcatctgtaaaatgggggtaataaaaatacctacttcataaggctgtcattaagaggaaatgagttaatacaatagcattaacacaatgcctggcacataataaatactcaattactgctgagctgttatttttattatgtacctcagcatcctcccaacttgagccacactgaattcttagcacttaaaatatttactgaccacatatgtgttccaagcactgtgcgtggtatagaattacatgagtggatagatgaattttctgttttaaaattgccttacaaagtatccccattttacagatgaggaagacaatcactttctgagaaaagcaaacaaccaaccaagagattccctcatgttccttcttactagccaataatttatactgaatatgatgacacagaaaaaaagaaaaaggtaggccaattcatagttcacttttcttttagtccttacttactcaacagtaagcctcaagtagagggggttggaagaatgtgtgtgcatccagaagtgaaataaaaacagttgagttagttttgtgtagcatggttgtgtaagaggaaacccctttcgcttggctctcattttctcttgctgccgccatgtaagacgtgcctttcgccttctgccatgattgtgaggcctccccagccatgtgaaactgtaagcccattcaacttgtttttcttttcttttcttctctttttttttttttttgagtctcactctgtcgcccaggctggagtgcagtggcgccatcttggctcactgcaagctccgcctcccgggttcacgccattctcctgcctcagccgcccgaatagctgggagtataggcacccaccaccacgcccggctaattttttgtatttttagtagagacggggtttcaccgtgttagccagcatggtctcgatctcctgacctcgtgatccacctgcctcggcctcccaaagtgctgggattacaggcatgagccaccacgcccagcctaaacctctttttctttataagttacccagtctcgggtatgtctttattagcagtgtgggaactgactaatacagcatgtaggaactatgaaatatgaattgtgtaattttattgattctgcttatgagttcaatgttttcatatttgcatttaaaattttgcattgcacaatgtaaaagtaaatggtaaaatccacgtgaataatgtaaaatttcatttatttattttacctagaatgatattaaatagcaattaaaacagcattatgacaagtcaagagagagatagtggaaggaaagaaaaagctttatatttagtatctttaacagcattccccccccacactgcacattttgaaaaagggatcctgcaaattatgtagccatccctgactaagatagggaaatgtctttgaattttagacttgagaagagactatgaaaagtctctcagagaaccctgctctgctcaccacccatcatattgtatgtgaagatggtaagagctacagggagtcttaaggtcacacagggagcaagtagataaaccaagactggtgcccatgccatctgactccattccttcctagtctagcattcttcacctaatgtgtgctcttccttctgtcagaaatcccaccttatgacttggagataagatttcccctttgcaattgaaaccatccaatcagtacttggctgatgatgtgcaattgatatgccttccatccaaggccagggagacttggccagcacttggttaaaagtaataaatagttttcaggggaaaatctagtggtcggtgttttagtccttgtctttcttgacctaacagcagcatttatttatttatttattattttttatttccataggtttttggggaacaggaggtgtctggttacatgaatgagtcctttagtggtgatatctgagattttggtgcacctgtcactcgagcagcatacactgtactcaattggtcgcttttttttttttttttttttttttttgacagagtctcgctctgtcgcccaggctggagtgcagtggtgcgatctcggctcactgcaagctccgcctcctgggttcatgccattctcctgcctcagcctcccttgtagctgggactacatgcgcccgccgccaagcccggctaattttttgtgtttttagtagagacagggtttcactgtgttagccaggatggtctcgatctcctaacctcataatctgcccgcctcggcctcccaatctgcccgcctccacctcccaaagtgctgggattacaggcgtgaaccactgcacccagcctaatttgtagtcttttatccctcaacccctcccaccctttcctcccgaatccccaaagtccattgtataatgtataattcttttttttttttttttttttttttttggggcagagcctgttctgtcacccaggttagagtgcagtggtgccatcccggctcaccacaacctctgcctcctggttcaagggattctcatgtctcagcctcccacatacctgggactacaggcatgttccaccacgcctagctaatttttgtatttttaatagagacagggttttgccatgttggccaggctggtcttgaactcctggcctcaggtgatccacccaccttggcctcccaaagtactaggattacaggtgtgagccaccacacctggcccattgtatcctccttattatgccttggcatcctcatagcctagctcctactgatgagtgaggaacatatgatgtttggttttctattcctgagttacttcatttagaataatggtttccaattccatccaggttggtgcaaataccattattttattccttcttatggctgagtagtatgccacagtgtgtgtatatatatatatatatatatgtctcacatatatcacagatttttatccattaatttcattgattaataggcatttgggctggttccatatttttgcaatcgcgaatttttagcagcagaatttaatcacgcgctcttctgtcaaacacttgtgtgttttggcctttaggacccaacctcctaccttgctggctgccctcccttagtcgccatcacagattcccctctaccttcctgactttgtatcagtgaagtgtctcaggggtcagctctcagaccttttctctttttctgtccatactcattcctttagtaacctcatgtagcctaatgactcttaacactatctatatgctgattactcatctgtttatacttctagccctgacctctccctgaatttgttctaacatgtctaactgctttcttgacatctgcactctgatgtccaacgaaatcacacactatatctgtaactgagcccttgaatctctcccccagctccaaactaagtcctacttcagttaatggcagcatcaggtcaaaaccctgcggctctctcgatgctttctcatctttcacacctcacacccaatccatgagcaaatcctaaagcctctaccttcaaaatacattcagaatatggtcattttcctccaccattactgcttcaccttggcccaaatcacctgcattatgccagtaatctttgaattggtctcattttggtcctcatctctcttttacccagaagggtctccttgaaccacatgtcggagtgtgtcactcctctattcaaaacctctcaatagtttctcatcttactctaaagaataacccaaaccaaacaatccaaacaagccacagagcctgacaccttcaggcattcagcaccagggccttaggacttcagctctcttgtcccctttgtcccctctctcactctgctctggccatgtggccaccttgctctttctccaactcactgaggactctcccacctcaggcccttcgtccttgctggccctctccctggaatgctctttccccaggaatctggaaggctccttccttcacctgctatgggtcattatcagatgtaacccctctcatgaggccttctctggtcaccttgtttaacacggtggccccttctgctccccatgcacattccccatctcccatccctgatttttattccccataacacttatctccatctaacatgccatccagttgactttattttctgttcattgtctgtttccccctgttggaatgtaattgcttatttgtctgtcttgatgtattttgttcaaatatctaagcctgccttgcggtgggctgtggtctaggtaacgtgatggccaaggatttaccaaggaataatgaaccacctccccacctcgaccaagctccatgaatgtctttgactccatattccagcctctacctggaatgtcctttgtctgtttctctgaataccatgccatccttcaaggtctggttgaaaagtgatctcctcacggaacacaaggtcaggagatcaagaccatcctggctaacacagtgaaaccctgctaaattatgcccctttttgttttattcacagactttagaaccaaatctcagggtaacatacaatctctcttccttccttcctcccttccttccttccttctttcattccttctccctcactcgctcactcctttcctccctttctttcttctccattccttcttcctcactcactcactcccttcctcccttgcttccttctttcattccttcctccttccctccctcccttttcccctttctttattctctctttccttccatcatgctttctgtaagactgaagggatcatactatgtatatcatttgacacttagtttttttcaagatgacaaatatcttgacatatttttctatcagcatggagtagcctatagtactaaagtttattaaaccagtccctgctgatcacacaaaagtattgcaaagtcttggcacaccgtctttgcgcacttgcttaggtttttgggtaggtcaagttccttaaagtgggttgctgggtcaaaggggatgcacatttttatttgctaaattgctgggttgccttccaaatccataccactgtatactttagtatgtgttcatttttatctccataaggcatcatataagagagctctccttctgcatttcgcttaggtttttggaaaagtcagtcagtcaaggtcgggaaagaagaggatcggggaaggcttccaagaggagatcacttttctttctttctttctttttttttttttttttgagacggagtgtcgctctgtcgcccaggctggaatgcagtggcgccatctctgcccactgcaagtccgcccgggttcatgccattctcttgcctcagcctcccgagtagctgggactacaggtgcctaccaccgtgcccagctaatttttttgtatttttagtagagacggggtttcaccctgttagccaggatggtctccatctcctgacctgatccgcctgactcagcctcccaaagtgctgggattacaggtgtgagccaccgtgcccagcttggttgttctttactttatgctccttcacagtgtttgaattgtatacaaggacacttttaccacaaggagtgatataaatgtttgaaaaatcacctcatagatgcagaagtagaaagtatacatgaagagtgtaaattaggttttactttaaaagtaatcaattgtttagaagtgttaaaagaaactgtggatgagaaattgttacataattatcttttcaatgaaaatgacaatcggttttgtttctcctcacttccctcatttccacccccccttccttcactcctttccccttctctttcccctcttcctgtggatgagaaattgttacattgttattaacttttcagtgaaaatgacaatcagttttgtttctcctcacttccctcatttccccctccctcctcccttcactcctttccttcctttctccttctccttctccttcccctcttccttcctcctccttcctccactcctgccttcccttcttcctttgttgttgttgttggaagctgcaggtatttcaaggagccagcaatcccattgcagaactgatgtaaagggacaaacagcatggaattagggctgcccaaatgtaatgcatgctacacaaaaatgcttccagtgagtctatctggggatgagggcagggagaaggaggagaggttggcttttagcttcacattgtccccgtgcactcctggacctgccatctgccccatgaaaggccccagtgttcagattgctgctgctgaaactccccttaggatccagagtgggcccaggctcatggtgccctgtgttctaggagccacatgatttcacaaactcacccttgcatttgctacattcttagcagggccctggaacaaaggagacattgaataaaaacagttgacatttattaagctcttactattatgtgcctgacttaggttaccttttataatttctcaaaaatcctatgaggcaggtatgtaaatctatattttgcagatacagaaactgagtcataggctaagtaatttccctaggcttgtagatctgggatttgaaaccgggttcttagacactaaggctagtcctttaactacaccctttactgcctccaaaaattatgctgaatgctctgatatcctgtcaggagatatttttctctaataaaatagggatgggaggtgtgtgttgggggagctttctagcttgtcattccttatgggccagcaggttggtgaggattagagccaaaaatctttggggaagagaaaaatggaaccacatggtctgttcctgaattctccaacagatccctttggtcccaacctccaagtgaggctcattttattctctctagctctacaccctagtttctctagtctggagtcataaacactggtgtatgcaaattaggcatcagagaaaagagaacggctgtcatttgctacagttggagtaaccactagaaagatggcagaatctgtaaaagaagagagcgtaacagtgacagcagtggtgggcacgttgttctctaatgcccattctcccttgttccaaggttaaagaactcctaatttgtagttttatacatggttgtccagagtcaaagctgtatattccagactgttttcaaattagttgtgaccatatgattatgttctggtaagatttaagtggaagtgtcatctgataactgctgggagacttccttaaaggggagctgacacattctctcccttcttcttcatcctttttttctttctgttggatgaaatgcaaattggatggcaggatagggcagccatcttgggccatgaggcaggtatagcaatacctgtacttttcagataagaaaactgagaatgcaatgaaagcaacaagctagaaggagcttgactccctgaggtcttcatggaacagtgtcattatactagccccagactgcttacttctggacttcactgcataagaaaattaaacttgtatcatgtttaaggaatattattttgggcctctgttacttataccatttaatatacatcatcacggcttcttggaaagatttcaggattggtaatgagatttgttttatttccatcttttcccctaacttatacgcttctaagttctcttgttcccaatatagaaattagaactagatatatctccctcacatgcattgatttttatattatagtaaaatacatttcataaaaaggagaatagagatttgaggagtggatgcaaaaaagtctgagggaatctgattacactggtatattttggctttaggctataggggggaaaagatcctgcttaattaattaatataagcacaaaacagagagaggactaaacattcaagttacagcaagaccagagatgacgctgggtctctgaaaagctggaaagagggatcctctgctgtcttttaaccctacttctctatcgtttggattcagtctttgttatggtggctttgtggcttcttccacaaggtgagttttgtatcttacagcattaggcattgaagagggatgactccctttcttcactgtgttgtgaggactctcagggaagagctctaactggccaatcttggttcagctgctcttcctagagacctatcagtcattgccaggaagcatgctgtgcaaaagaactgttcttgcagaatgtggctatgtggattgtatataacgagcatgtgctacttttatcgtaagtgatgagatgaatgtctggagtaatgaggtaagtgtgggacgtggtgagtaggagggcatggggggattccccccttcctaaaaaggcagcgctgacagcacacccctaggtgaccactacggtgttcaggaatagcaagagcaattctattgacaacggagcaaagtgtggtggaccgggtggaagtcaagagacgcggattctagccctggcaccataaggctatttggcacatctctttcttcagtgggtttcagtttacatatctgtcaagtgatgatgttaaatcagcttgaactagctcagttgttttcaaagctttttttcgtttacagaggtttttggggtgcacgggttagggtgctagggatcctcactagatcttctttccattctctacaaaacccgcccattttcacacacacacatgcattgacatgcactcttacacacttacactcccacccatgctcacagacacgcacacattcacacacctcctgtcacatacacacacccatccacacccacactcactcttacttcctcacactcacctgcacactcacccgcatcctctcacactcatctcacatacatactcacacatccacctaaaaacacaccctccctcacacacacagacacacccacacttacacacacatgctgtcgcacaggtgcacacacgctctcacacagctacacatacacacgctctcacgcaggtgcacacacacacacatgctctcaaacaagtgcacacacacacgctgtcatacaggtgcacacacgctctcacacaggtatacacagacgctctcacacagatgcacacacgctgtcacacacgctctcacacaggtacacacacgctgtcacacaggtgcacacacatgctctcacaggtacacacacatgctatcacacaggtgcacacacactgtcacacaggtgcacacacacatgctctcacacaggtacacacacacgctgtgacacaggtgcacacacatgctctcacaaaggtgcacacacacgctctcacacaggtacacacacacacgtttagtgtatgcggagtcacatttgttctccagagcttgttggattggatgatctcaagtgtccctcacaagttgtcagcatccatggttccattcaaattgggaactttccagggctttgagccctaaattctggagagcagcagttgttacagagaaaagtcataatgaagagagtctaaacaactatgagagactttctaccctcctttgctcttcctcccccatccatcatggccagcaggctggatgtgtcctttcactagtgatggaagatgaagaacatctgtagatccccagggagctgcatttattaaaaaaaggtctgcatagccctattaatacacaatgtcttgcccatccttgggtccatctatacagtactgatccatctttaaatacatgtaaaaataaaatgcaaacatagactatctggcaaaaaataaaataaaataaacatatgtagatgaggaataaaattaagatgcatggtatgttttggtttggagctattttctcagtgagcagtcatcaacgtaaagaaactgatgtgtggggctgcagagaaatggattgtcttggagaagtctcagcgctaagtctggagtcaggcgtcttctcccctagggcaggcgtgtgcttccaatgttcctgctgcttggggcagggatggccccgccatcctttgctatctctctgatctctccacaggctgctatgtccctccgcctggtgagaagacagactctcccaagcacaaagccacgctgtcttgagctggcaccttcctgcgtgggaacccagaatcactctcaacagccctttctttctccctgcagcctgtgagctggggaggcggccagctggggtggttcccacattgggaaactgggtggggcctggggagccccttggccttggtcaagaagacagacccaggcccctccctgggaattctatataatgcagaagtggcgagagaaagagagctttgtggatagtcgcctcccattgggacatggattggttggccactgacactgatgtgggcagaaagaagtggctgttgttttaccagggctggcacctggttaggacgaagcccaatcccctttggagggccccagatggggttcaagtgggaaaaaatggatctcagggcagaatctgatgtggattcctttctgggtgttgagaaaaacacaaaacaataactcttcctttcgcctcctaagaagtagagtaggttcagcaggatgaagtaggtttcttgggattaagggtacgtaggatgttctttggcaaaggtggtcatgctttgaaaagggggatgctctatggagctgtggggaagagggaagaggggaggttcccacatatagggtgttgtgtcagaaatgaagagggaggcagcttctccttctcactatctcctcccccagagagggacccagcaacaggagtcaagggttgcccccaacacagctgagcaggaccctccccactgtgggtcttgatgcagagcatgggccgttcggtcattgctcatggatgaaacgaccaagcctgtcttccatgtttcaggcacaataaacaaaagatttcaagaagctcactgtgtactagggaaggcagacaagccaacaggcagatctgacatagtgccatgatagtggaaggttggcagccatgggagttcccaggagggtaccccatcaggacttgaagagccagggatggctttctcgaagaagcaacatttaagctgagagttcaaagatgagttgggcttagtaggatgaaggaggggcagagggcgtattctagacagaaggatttgtacgtgcaaaggcttagggatgagagaaagatggtgagttccaagagttcaatacagctgaaggttttaccatatgtaagtttccccaaatgaggtgatgccagagaaatgagcgtggctctgatgtgcaggacagtgctgaggagtataggctttctcctgggggcaaaatcatctcctgggagccctgatgggtatggagctccagagtggcacgattgcatatgagctactctgtggaggtgtggctactctgtgggagttggactcaaaggggataaaggcggggaggctgttgctgaaacccaggcaagagatggcaagggtgagagtgtggatagtggcacaggggatgagtgctgggcgggaggggacccagatggagggcagcctagatatgggtagagtaggagagggagaaggagaggtcaaaggtgatgccaggtttctggtttagcagagactgagattgttttccaagctgtgaattgcacccttccagctttggggaagccatttctgcagccagtcttgtctgtccctgagggatggttctggagttggaattggggtggggaggcacctgggaaagcgatgttccagtgaagatagtggttctgatagaaagactggactctggcctgcatatttctcatgcaaatctgccaccagaatgttcatgtcatgagggaaggggctttgcttctgttgctctcttttgttgctacaggtaatgcctatcagtgctaccagttgctagaataatgcctgacacacaggagatgcacagaaaatgtttgttgaatgggaaaatgatggtggctacaggtacaggattgggaggatttaccattccaatcagtgaaatgggataattggatccctttgatatgtcacagaaacgtcactctggtttcatcattccttttgatcaaagggtgtctaagatggtgcagatgaccagaatggagagaagagggataatggcatatgtatgcacacataggtatgtaaagtacacgccctagatgataaacaaggcaatacaccatgatggcttaataactttcattgtcatcatcagcatgggtatcatcactagcttagattgatacgttaacgtgtaccagacaccaaaacttgcaggcgctttatatccattatctcatctaatcatcacagaaaccctatggaggagatcctgatatgattatagttggactcatgcagaaactgagactcagagaggtaacagatgtaccccttgtcacacacctcagctgtgccgggccaaagactgaacaaagttctgtctgaatctaaggccactttccctctagtctgagctcttgtttcatggaagaaacaaatgtggttgaaacagaaactaagggtagagagaaaactctgcaatgtcccaggaggcctctaggcttggtaagagtccaaatgggccggagaactttctttggcccctgacctggctggacagtcagcaggaagtatcatcttgtgggtttgttaatttaccatccacctgcaagccttgtcatatatcttccagacctgacaaaataccctcacctaacacaaccctgtccctgcttagtgtcttttcaaaaccaccaccaaatctgagaagggagagccaggagcaggtgcttgccacatcctctcctggaatcagagtgcagcaacctagggctattgttcagctgcctgggacatggcatcttaggttggggtgattctggagacactgggagaacagctggcatctggtgtgctgggctgatgctggagacgttattaaaaagtgcctcctgcaactctgcaccccaccccagccccagagtaacacgtttcttctctttcacccaagggtaccctctagagagatgagtcactgctctgggggaaggaagttactatggaatctgaaatcaaaggtgccacttttctgattattaagctaaaagccagctaagctgcatgaaggctgacagattcagttgcctgcttttgttgtttttcttctcactgcaaacttgatgaaagtctccctgagctagcaagtggtgagcgggaggcgagatcacagacagggacccagtgagggggaagaatttcccctttgccctaggagccccatgatggccagaaacctaatcagagcccaggtgtcctgctggttgttgttgcatgaggaccacaggtgaactggaggaaatatctgtcttgaagacattgttcagctctcatccaaactgtcattgtgtggtcaatcccctatccagtggtccagagcactcttccagccccaggatgaactctgaggatgaagactacctgaaaggtatctcagatgatactggcccaagatctcccctgaggagccctcccagcccctgcccttgagcacgcatattgaaagaaatactgtctttcatcaagcctcctgccttcacagtgtgtccacttgcagagaagttctgggtgatgtccacaatgctggttcattaaggcgtatcccagggctggaagccagtcatctcatcagggaagggcctgggtatttggaaggagctgggcagaggcaacaggtcccagacagcttggcaccagcaagatttatctgggcatttgtcagaactgccagcttgtcctagggagtttccctatctgcagaagcccggaggtgtgtggacagggccctgtgccagtgcaaagtctcagtgtagcctccttctccagacaaacaccaatcataacagcttccattttctttcttttcttttctttctttttttttttttttttttttttttttttgacagagtctcgctccgttgcccaggctggaatgcagtggcacgatcttggctcatgcaaactccacctcctgggttcacgccattctcctgccttagccccccgagtagctgggactacaggcacccaccaccactcccggttaattttttgttttttttttttttagtagagacggggtttcaccgtgttagccaggatggtctcaatctcttgatcttgtgatctgcccacctcggcctcccaaagtgctgggattacaggcgtgagccactgtgcccagccaacagcttccattttcaaatggcacccacgtgacaggccttgtgcggccagctctacatgatgtcatcacatccttctgagaaccatgcacacttgggaattattcttcccctttacaggtgagaaaacaaagctcagaggctggtgacagaaccacgacaatttgaagtctaatcagtatggtttcaaagctcaaattctttgcaattaaactcaacacatacatattggacatacatgttgtggcagacgcaatgctagactcaggggcttcagagatggataacgctgttcctatcctggaggagcttaccagaagctttgacatacccctgaaaatgctctagcacctgggattaaggaggcttagaggaaggaggaattcactctttctgggtaatcggtgatgagtttttcagaagcagtgatcctctatccagctttcgaggagtgtgccaggggaagaagacccttccaaatgcgctagtatgtaacacatctgtactaggatgtttactgtaccattgttcatggaagactgcagggcagtgtgcataccataaatcctcattggtaggggactggtggaataaattgtggctcaatcacatcaaagaatattttgaaaccattgaaagaaacaaattagagtcatatcaaaatgacacaagattgactgggcgcggtggctcatgcctgtaatcccagcactttgggaggccaaggcgggtggaacatgaggtcaggagatcgagatcattctggctaacacggtgaaactccatctctactaaaaatacaaaaaaaaattagccggtcgtggtggcgggcgcctgtagtcccacctactcgggaggctgaggcaggagaatggcatgaacctgggaggttgagcttgcagtgagccgacatcgcaccactgcactccagcctgggcgacagagcaagactccttctcggaaaaaaaaaataatcataataaaataaaaaaagacacaagattgagtgaaaagcaagctggagagaagtgtgtgtgtgtgtacacagataggcatgtatgttgataggaattcagagcaagggattccctgcagaagacacagcatggtcaaaggtaaggagatgtaaataatgtctagggaactacaaagagctcagttctgctggagtgtcatgaggaaggtgaggcctcagagggaggcaggaagttcccaggagctgaatagtaggtgtggttggaatgagagtttgatttggcaattggataggcatctttaggaactggcccaatctggggagattcgtggctgaattcaggctgggattgggtgttgtaatggtcacagccttacagaaaaggtggaaatgaatttgactctagaatggaagtccagtcaatggagtgaagcagaacattggacaggagaatccaggcacctgcggcccagtccagtctagcacaaactcactgtgggctctcagatgtcccttttcctttctgaatctctcctgtctattcccacttctctccaaatgtgtgatgtcagatcacacagaacgccccagccacatccaggcaaggtccctcaacaattagtccaggcaggacaacaaactctaaccacatatctgtccccacagcttcactgaaagtactcttactaagatcatccttgtcgttgaaagaccttcctcctcctcctcctccttcatcctcctcctccttcctcctcctctcctcctccttcttctccttcttctccttctttcttcctcttcttcctcttcctctttttctccttctccttctccatctcctcttcttcctcctcctcctcctctttcttctttcatcagaagcatttgactaaggagccatcctctcctttgcaaaacactattcatctcagcttgtgtgacaggacaactcttatggtttttcttctcttccttcatattctttgctggctcttcttttttaaactctgaaatttaactgctactctatttctttgactattttagatgcctcatataaggggaatcatgtagtgtttgtctttctgtagctgacttatttcacctagcataatgtcttccagatccatccatgttgtaacaaatatcaggattttttctttttttaaggctaaataatattccattgtatgagcagaagacattttcttttttctttgtttctttcttttttttttttttttttttttgagatggagtctcgatctgtcacccaggctggagtgcagtggtgcgatcttggctcactgcaacctccgcctcccaaattcaagtgattctcctgcctcagcctcccgagtagctgggactacaggcacccacaaccacatccagctaatttttgtatttttagtagagacagggtttcaccatgttggccaggatggtctcgatctcttgacctcatgatccacccatctcggtctcccaaagtgttgagattacaggcatgagcaccgcgcctggcaataccacattttctttatccattcatctgtcgatggacttttgtgttgcttccatattttggctattacgaataatgctgcaatgaacatgagagtgaaggtatctctttgagatcctgatctcaattcttttggatatatatccagaagagggattgatggatcatacggtagttctacttttatttttttaaggaacttccatactgtcttctgtagcagctgcaccattttacattcctaccaacagtgtgtaagtattttaatttttccatagcttcatcaacacttttgtttttaataacagccatcctaacatcctaacaggtgtgaggtgatatctcagtgtggttttgatttttgtttcctaatgattagccatgttcagcatcttttcatatatctgttagccatttgtatgtcttctttggagaaatatctattcaaggtttttgcccactttaaaactgggtgaggtttgttttttggctttttttttttttttttttgctattgagttttaggaattccttatatattttggaaatttatcccttacagcttccacagtagttttcttcatgcttattttactaaattaccttgattatttaccttgtctatatctttcttctctgtttctcccactagaatataaactccatgagggcagagcctagtctgctttatttatgtcctcagcacctcaatgcctgacatgtaatagaggttcaggtaatattctgtaatcgaatgaataaataattattgatttctacttctaaaagtccttctttatttacttctaaactacagctcgccatggtgccttggataaatctctcattctagccacatcctcagatattctctttccttttctgtggctccagctcaaattcaattttctccatgtggtctcctttgactttttatggcagaattatgcactcccttctctgtgctcccataccctttgcctctgcctgaattcatgcacttgtttaattctacttgatagtactgtttgtttttcccttgtttgtcttccccagaagactgtcaactctttgaggacagaggtcatgctctaattttgtctgtattccacagcatctagttcagtgtgtttttcaaatcaagacaccttgttgaatgggatgggatctggctgacagcactctcacaccgttgcttgcacagactggccaactggtttacctggtttgcccaacaaagcctccttagatctaggttgactccctgttccagaaggcaatcctgtgtactcaacttgctagtaggtttcatcctttggattcagaatttcctatttgttcagagttgtaaatttcagtgccaagctacaagtccaactccattcattatcctctcttttatgttcatggcatatttcaaagtcaacatctaaagtcaaaaatcaaaggatttccaaacttagtttttcctctctcttgaggttccttccatatatctaggctattgctaacatcaaatgtcccagctccagaaatgcaggctgggctgacttttttctatgctctagaagaaagctgtgaaactcagcaagatgtgattcctccccttctccacatatcttcacttgttaaattctacttcttatttaaagctcagcacaatcaatcttttctatgtttcacatatcacttgccatgataagggaggtgggagcttgcctggcaggctcaaggaatggcaagaagggtgatgtagcttggtgaagtgagggaggagagagtatgggagatgaggtggcagagtcgacaggggttgcagagggtgtagagaagtggttctcaaccagggggccattttgacctccagggatatttggcaacgtctggagacatttttggttgttacaacttgggagtggggggtgggatgctactggcatcgagttagtagacaaaggtcagggatagtgccaaatggcttgcctggcaggtttgagggtatagaggaatggttctcaaccaggggccattttggccccaggggatatttggcaatgtctggatatttaccttgtgcctggatttgttctagatacactttcacctacatgtcctctaatcttctcaacagccatggaacacacatatgatcccatttaccatatgagaaaaccacgactcagagaggctgaggttcctggtcagtatgtgaccagggcaagactggacttcagctcacctgaccaggaagacagtgctttctccaccctatttggctgttgcagctgctgactcaatccaccattcacaatagtacctcactttattcaacaaatattttgcaaacacttcctatgcaccaggcagtgttctaagcactcagaacacattagtggatatagcaaacaaaagcccatgaaggcatgtagatagttatattctagttgtgggagacatactaaaaacgatcaatagataaaacaagttatgaagtactagaaagtaaaaagaggtatgaaatgaactgcagggcaagtgggatagagagtcctggaggtatgggatggtggacacaatttcaaatacagctgtcacgaagccacattatgatggtgatgtttgagccgagacttagcagaggtaagagagttagtcatgtgggattggggaaagacgatgtagcttggtgaagtgagggaggagagggcacgggagatgaggggcagcaggggttgcagagggtggagaggagtggttctcaaccaggggccattctgaccccaggggatatgggcaatgtctggagacatttttggttgtcacaacttgggagtgggggtgggatgctactggcctctagtaggcaaaggtcagggattctgcaaaacatcctacaatgcacaagtctgcccccacaaaatagaattatccagctccaaatatcaatcgtgtagagactgagagactggttgagagccaagatcttttgaggatcttgaacagaggagtgacatgatttgacttacattttgcaagatgcctctggctgctgtattgagaatagactataaggataagggcaagggaggaagcagggacaccagtctggagattactgcagtcacccaggaattagatgtaggacgactcatccccttctagggtggaaggccctggaagccagggaggaagggcagtagcatttacggagcacccagagggtgctaggctttcatatacattatctctttagaccccatctgatctttattagtcccagcacttggattggagttaagttgtttaagtagtttgacatcgctggatgtaaatgaggctttgagtagaaagaagagaaggtttttattgcacagcgtttgacgaatcagtatttattctgggtgatgttatttttcaccaatagggtggatgcctggactgcaggtaggcacatgcccttgtaaaggcacacgaagaaactcttggagaagcccagacagagctctcctgtggtacccatgtgttatcatttagcagatatgcccttggaaggtgccttggtgaggctagctgtgacacattccgttaagaataaacatttgcatagggcacctgaagccaggcacctgtggccacttttcctggaagagccaagctcttgaaaatatctacattagggtctttcctccaagaactggaaggtcatccatgcaagagtggacaaataggtgtgatgcgggttgcagaggagcaagaagctcagccaataaaatgccagatggtgactcacagcaagtgatgatggagtgagcttgtttgtgtcatgccagtgaaataattcatgaccatatcaatggtgtggtcctgctctttcttctgcggaggggagcggggtggggggcagtgcaggagatgatgttgatgacattttctgcctcttaattgccttcccccttcctggggtaggtgatcaggctgaccaaacccctcctccttagaactctctcctctctaggcttccatggccatactttttatgccctcagctccttcctggtgccatttcttctgcctggaatgcttgtttcttagggctcctgtagctctgcttcacagatcgggtggtttaaaaacagcagaaatgtattctcgcagttctggaggctggaagtctgaaataagtaggggcttcctcttcctagcttctggtggttgatggcaatctttggcgttccttggcttacagctgtgtcactccagtctctgcctctgtcaccacatggtgatcccgtgtgtttctattttcacatggccgtcttctataaggacaacagtgatattgtggtgacatctataagatgtcttcatgctggtcctaatgctcagtacttcagaaggaagtatttacttggaaatagtgtccttgcagatgtcattgtccttaccttttttatgtgtgttggggggaatacaatttaacccataacaatacccttctctactttcccctcatagtctagaagtacactagcaagcaagctaacactgcagtttctgggagaattcttaggttctcttgctactggggccctcactgaatggatggatgcaagtctcttcagattgttgttttgctgcattcgtggacttttggtccactagtattcattcctaaaaggaacaattcctatcccacccatgtgatcccaattgagcatcaaatatgatgcatagattcccaaacaacagtggttaatcagagtgctgcatccctcccaggaacaatgattgatccagtgggggaacatgacccaagaagggacgatcacagttcttctgtgaaatactgaaataaggcgttaggagagtgagtcttcctttcttttgaacacagttggagcttgcagaagccttcttgtctaccacataaagtgatctaatctaaataatgaagcaggaacaagcagagcagagagaggagacagagatagagccctgatgacatcatttcaggtcctagatccagctgtgcctgaagccattggccctggaattctaagaaacaaaaacaatgactttcctttttctcttaactacttggagttgggttttttcttatttcatttgaaggagtttattaattcagctgccttccaccatcaccaagctcttttctaaaacagcaaccacatcattgtcaaacattgcattaacactaactctttacaatgcaaggcactctacagagcaatttcttgcacttgaaagcattgaattaggattccccttgctgaactctgagccctcaagcacaccatgcatttggcaaaatgccttggatgttttttacattcatggctttttaactgtcactgctacacgttcatgaaaaggggctcataatgcaataaagagagctctaaaacagatgtcagaaaatgtgggttcaagttccggctcttccaattactagcagtgtgaccgtcaaaaagttacttggtttctctgagccccaatttctctatcagtgtaacaggcacactcatttcctgccctatctaattctcaagattgttgggaggacgaaatgagataaagtaggaattggcaaactgtggctcatgggccaaatatggtccactgcctctttttttataaaccaagttttattgggacacagccatgccccattgtttatatatggctacattcctttcacactacagcagcggagccaggtgacagactttatggccggcaagcagaaaagtaacattatgtcaagggcattttcccattctatttactgtctggactttacagaagaactttgacaattcctgctctacaaacacaaggtagggtttctgttgacagcagggtttcctcaggtgattcctatatccctacctggaaaacttcttcaaggagtttttctaaagtgataacatcccaaaattagcaagatgaatgatgaaagtgagaacaaactttctggagggcaatttgacaacacttcgaaagcctcagaaatatagtcatgtgccacataacgacactgtagtcagtgatgaaccgcatatacaacagtggtcccacaagattgtaatggagctgccctatacaggtgtaccacttcttatcttgtggccatatttttactgtaccttttctatgtttagatacacaaataccaatgtggtaccactgcctgcagtattcagtagtacatagcatgctgcataggtttgtagcctggaagtaacaggctgtatcatctagcctaggtgtgtagtaggctagactatccaggtttgtgtaagtgcgctctgtgatgttcacataatgacgaaattggctaatgatgcattgctcaggacataacccagtcattaactgatgcaatactgtataacattcgccttgacctcatcatcccatttctaagaagttgtcttaagaaataatcagagttgagatgtatctacaaatttaagaaatgatggtggaataattgcttaaattattcagcaaattatatagtctttccaaattatgtttccaaagaatttttaataggatgggaaaatgtgcctgttatagtattagtgagaaaaaagtcattaaaaaacacatttaatatgatcccaattttatcaagcaaaactagcaggaaacacaccccaatttcatggcgattttctctgggtattggaattacaagaggcttttataatgttaatttttatttttcttgttcttttttatttctttttaatctgaaaaggaataatttagcgaatatgggttggataagcttgagaaataactgatgatttgagttactctcttatcattatatagaaaaagggtattatcctcaacaggtgtcatgtggggcatgtgggtgagtggaaggggatgagggtcctggagcaggaggagagtctgtatcctgcagtgacagctgccactcaactctgccgaccatcgccatgtggggatctgacgtagactgagtgttgtacatcttctacatctccttttttttttttttcaagaaaagtcagagatttagattgctatggggatttaccacactgatatgtgtgggtcaaataaaccactccatgcctcctgaatccagcttcccaagtcacccatttgaaatgcctgctctagagccattgagtttggtgctgaaaggagagctacagattttccagtccagctgctcctccattttttttttttttttttttttttgagacagtctcgctctgctgcatctgggctggagtgcagtggcatgatctcggctcactgcaacctccactcccgggttcaagtgattctcctacctcagtctccaaagtagctgggattacaggcgcccaccaccacgtccatctaattttttgtatttttagtacagatggtgtttcaccattggccaggctggtcttgaactcctgacctcaggtgatccgcctgcctcaggatcccaaagtgctgggattacaggcgtgaaccactgcacctggcccagccgctccatttgattttgatgttatgaaatgccttatccagagtcacacaactaaatatcagcagagctggaagtggagcaaagaggagttgttgcttctcagaccagaactgaccattgcagtgccatcacctctcccctcctatagctttctccatctcagaaaactggtgccagcactgccccaggtgcccaggctgagtgttctccttggtacttatcaaacatgaatacccagtaggtcttgtttttatttatttatttatttttatttttattttctgagacggaattctcgctctgccgcccaggtggagtgcaatggtgcaatctcggctcactgcaatctctgtctcctaggttcaagcaattctcctgcctcagcctgccgagtagctgggattacaagcgctcaccaccacgcccggctaattttctgtatttttagtagagacagggtttcaccatgttcgccaggctagtcttgaactcctgacctcaagtgatctgcccaccttgatctcccaaagtgctgggattacaggcatgagcaccacgcccggccggtctcccttttaaatataccttgccttcatcctgtttccctctctttccattgctgcccgctaagtctaagcccccattacctcttgccaggcccattgcaatagcttcctaactactctctggtcctgtcattcttctgcttaaaactttggttggtttccaaagagtagataagaccctgctccactcccgcctccctcttgagctcaccttgtatcactctcccccttactatagtctttcaagtcctcgaacctgctgttttcctcctcgcttcaaggactttgtcatgcctcccaacctgtctggcattctctgttcacatctctccctattgttaattccaaagaatccctgtggtctctgaatagtgctggcccatcctaagtgccatgtaagtgtcggctgttgtgatttttactgttatcatctcagcccaaatgtcaccatcccaggtcaggtcatcctgtgattccccttcacagcaatcgcacagccatagttcagtcatcaactacccttatttgtttcccagacactgcttccttgagactccaggggacctccaggacaaagactgagtcagtcttgttcaattctgtatatccccagtggatgtcagactatatttgaaagcactcaatacgttgaatgctgctgagtaaacgcttacgtctatatacatgtatcaactctaatgtccagtggtaccttcaaccccacttccatgttgggcatgttcagatgaggaaactgaaggtcagggggtcataagtgactccatgcgtctgtggctcatgagaacataaactcccaatcctgaggccttagcgtggtgctctggcctgtgcttctggttctactggctgggtgaacagttacttctgctacttcccgttcaaaattggtcaacatatatatttttcagtggcaggaagtcttgcccgaggtgggaatgttactgggttaatatctgggggaaagagaaatatttttccctttgttagctggctctgggcagcctgaaaactcttgatcctctctgtctgctgcttgggacataatgacctgctttcaatccctttcaattacaggatttctgataggaatttggaaaacaacctaaatcccaaagcttggatggtagcccatgcttcattccacgtctctgtacccagtttttcaaagagatttttttttttcacctgctcctcaggcagagccttgtcctccaccactcccattcctcccaaattccctgcctggggctgtccagccacgcttcttgattttctcgctggatggaagcctccttttgcctcccatgctgggctgtgtttttcggtgctggtggttgtcctgaagcagtcctcagcgggtaaaatacttgggctggtgtctagggagaggcagccgtaggcaggggcctgggggtgagcaaagccaggtttgaatgcttgctcttccttgtgttagcactggggccttgggcaaccgacctaagaccccaagcctcaatttctttaattgcaaaatgggaataatcatatgtatctttgggatttgtggtggaaacacacagcacataataggcaatctaaaaaatcatttcttttctcatctaacttttggtacaactaggggtagtgggggtagcaggtacattgaagactacagtgatggcttagggaagggagcatctctgcggagattgggcagctgaaaagtctagtctagggcagagactacagcagtctatgccctcgctgcatgtcagaatgagtggaaagtgaggagtggaaaatgaatgacttctggacattggagccagacagacctggtttgaatcccagttttgccacctaatggccgggtgactgtggaggattcaactgctctgagccttcgttgctgcatctgtaaaacagggactcccgtgtcacggggtaccatgagaattggagtaagatacaggaagccatttattctgcccagtgacctttactctgtgatcttctcctgctctaaaggaatggggatactctggccctgagtttgctccagggcgtctcctggggaggcacaaataggaactggaattcttacctgctttctttgtttcctaaatgacaaaagttacagcagcttctctttattgggcaccgagtgttcttagtgttttttaatagtgaggagactagagcccagagaccgtggcttgtccaaggtcaccaagagggtcgaggagagagctggattgtctggtcctcattatggactgaatgtttatgccctctcaatagtcatgcatttaagtcccagatcctaatgtgatggtgttaggagatggggcctttgggaagtgattcgtcatcagggcagagtttttcatgaatgggttctcagtgcccttataaaagaggcccaagaggccaggtgtggtggctcagcctgtaatcccagcattttgggaagccgaggcaggaggattacctgaggtcaggagtttgagaccagcctggccaacatggtcaaaccccgtctctactaaaaatacaaaaattagccgggcatggtggtgggtgcctgtaatcccagctacttgggaggctgaggcagaagaatcacttaaacctgggaggtggaggttgcagttagctgagatcgtgccactgcactccagtctggccaacagagcgagactgtctcaaaaaaaggaaaaaggcccaagagagatccatctccccttctaccctgtggagatacagctagaaggtgccatctatgaaccaataaacaaaccctcacaagacactggatctgctagtgccttgaccttggacttcccagcctccagaatgatgagaaatacatttgttgtttcagcctcccagtctatggtatttttgtgatagcagcagaaatggattaagacactcacaaagcacatactctttctccacaccaacctcctctctgactctcttctcaccactgtgagcctggattcctgaggctcggatggacctgagccagctgttatggccttatttggatggggtcactctcatgggagcagcagtttcatcccctttccctgtgctcaggagctccttccacatctcaatgcccccagtttactaactgcactgtccccagcatgtcaggcaggcgatatcaggaggtggtagtggtgggaattctccaccttccctgcatccctccaccaggtgggagctgtggcaggaagaaaggctgatcaggtgctcccaggaagacagggaggaagaagctaaagatgatcaaggaaggataccaggggacagttctgattctagggcagagacaaatttaccttcatttcttctgcccacatgggaagcgagggctcatgagcctgccccctgcaaatgggagagagaggtccataagcatcacactccagaggcagaggctggactggtaggaaagaggaggtggcagtgaatttgagccccacaggatggggaggctgtgggctcaggctgctgggaaagccaaaatgtgatgaagagagagcttggggtgacacatttgtggaataagcccctcctttaaagcttggtttctcagtccatgcttgcctcccttttttctctcctacagaacgtcactcctcttcattcccctcccactcctgcagtctcacagaaactgaccagtggccttgctgggcgccccggttccttcacccataccctgggctctgtggaacatcaacacagcttgattcaaaatcaggaagaagactactgccaggacagcgctgtgcttgtcatattggccaacaggatgccacccatgaagactgagcaagaggcagctggtcaccctcttgagctcctggttagttgtaagagagaacttcccttagcaggtggatctgggaaggagtagccagggacatgggctgcctttacttttctggggaacttttaaaaacaagccatatatttgtgtgtctggcaggatttaggtaaggtcttgcctaacagaagagaaatagatgtttgccttcccggaaagtatggttacttctacatccacccgcccataatctcagggcatttcagtgaatcagatgagggtgaagactgggattgggagactttgcagggggtactccagatcagaggagaatgagagcaaagtagttatgggggagaaacgcttggctaagctgccttcagaatcttgtgagccggcttagttctgggggtggtggcggggagagaaaaagccaagtataagtgaggcatggggcagagagagaggggcaaacaggaagaaatgcagccacctgctaagatacccaccaataagggcagagtctagaagacacctgtaggccctcaccacattctctgaaaactgtctgtcacctccatccatggaatgagctcctggggtgaaagtttattttccctggtaggaaatacactggtagcaggtgggaccagggttggaccctggagtcatgcaggccaatcagatcacctctcttgaagatttgcaacaaaaacaagaaaacaactggggtaattggtagccttgcaggaaaaagtgatgttactctagagctgctgtggtcattgttttttttttgtttgcttttgtttgtcattgatacaaaaaagaaaagacaaaaagacaaaaaaaaaaaaaaaaaaaaacaggacggtctgcaaagagagaagagagtgcagcagacacacagctcaaagaatcttaatgcaacacatgagctagtaggtccttcagtttagaaactgctgcaaacaaccactgcctggtcctgaggatctgagactcagagcagcctgggaggtggggaagccctgggaagccacctctgcatccccatcagcctgctggagctcagaggatggccagcctttggtcctctacccagaaatgacctttgctttattctgcatcatttctgactccagcacagcgtgtttattagcatgcattcaggccctgggacgagcagactaagcctccgacgcaggccaccaacacgctcactgtgggctccaaccaccctggaggccttgtcatttgtgaaagacccatgtgcttttctgtctccgctgcttctgctttgtctgcttgatctgaacctcaaaaaatgacagccattctttaaagttcagctcatgtgtcactcgctcttctgaagccttttctagcttcctcaggcataattagtcataattagttcctctctcccatcacttcccaaagccctgtctttgtagagtctccattatggcatttttcatattatattatacacacttgatatttaaattacatttcaaaatacaggtgtactacatgttttcggcataaagtgaagaacagaatccctctcctcctcaaatctttccagcaccatttcccaaagctaatcacaattagcaatatatttggagggctcccagaaatttctatgtataaataagcatacataaggacggctggatgtgcagtagcccccttatctgagggggatacatttcaagaccaccagtggactcctgaaacctcagatagtactgaaccctatatatatatatactatgtttttccaattacatacatacatatgatgaagtttaatttataaattaggcacagtaagagattaacagcaagaactaataataaaatagaacgattataataatatgtcagtatcactacccttgtgctgtgcggccatgatgaagtaaaatcaagccccgtgacaccaccactgtcgatctgataacagatggctgctaagtgactcacaggcaggtagtgtagagagcgtgggtacagtggacaaagcatgatgcatgtttttgggagaacagagctggacaggacgagatttcgtcgtgctactcagaacaatgtgcaactgaaaatttatgaattgtttatttctagaatttttcatttaatgtttttgaactgagattgagctctggtaactaaaaactgggaaaagtaaaaccgtagataaggggaattaccctgtataggtagttgtttggcctaaatcgggtaatataatattatttttctgtagcttgtttttttttttttttttttttttgagacttgctctgtcacccaggcaggagtgcagtggcgcaatcttggctcactgcaattccagcctcccgggttcaaatgattctcctgcctcagccacctgagtagctggaattacaggtgtgagccaccatgcccagctaatttttgtatttttagtagagacggcatctcaccgtgatggccaggctggtctcgaactcctgacctcaagtaatccagcctcccaaagtgctgggattacaggcatgagccactgtgcccggcctgtaacttatacttttattgaacatctttatttttgtagaaatgtacattctgtttccattaatgttctgttggatatatttggttgaaatctgtcatcttattttattctcttttttaaaatgaaatgtttgttttctactttttgttatatttttgaagtttctgttttttcctttgttttgtttgtgagctatttatttatttatttatttatttttaatgttttctctctttctaatgatttggaaggtttatagtctggttttcattcttgaactggttaccattatgctttaaatagcatactgaaacacctatttcttgatttaccaattttattctacatccacagactctcgactatgaaagatgtagaaactcgggcaagcatacctttccccatatcccttcccctgccacatataagccatttctttttattctctagtggtttaggatatttaccttctgttctctaaccaggagcccctcagctgtttagccttagtttggtatttaaatggatacaatgtttaccatcaatgaatgcttactttctacagcttttctattcctaaattgataatattgatacagttgatcctggaacaacacagggttgaactgtgttcgtccactcatatgtggattttttccaataaagatagttggccctccatgtcccttagttctgcctccacagctgaaggcagttgaaaaatatggtattctcaggatatgaaatcgtgtacaggcaggaccaactttttgtatccacgggtttcaaggggccaactgtaggtgctaaagtatgcatggattttggtatgtgtggggatcctagaaccaatcctctatggatactgagaaatgactatatatttttggggggactagatttcattatcaagttgtccacctcctctattgaacttatgagttccatgcgctattttctctgagtctgtgctggtgaatgtctttcagctactttatacatgaaagtcaaccagactggcttttaaatttgaaatgtgtttgttacaatagcttcagaattttgtacctgttccttttggcactaaaggataaagagaagttggaggccagctttatttttccttcagaattttgactgaacattctccgtcaaagttctatggtatattaagaccacttttaattctgtagaggcatttctttagttcagaaaagttttcttttataatatctttgaatatgtttctgtcttattgctctgttcctttctttaggaatgtccagcatgcatattcatatttcctaagtatttttcattattttatttcattgtttttattatttctccttttctttcattaaaaaactcttactatgttactgactctattatcaactgaataaatcccacattctgctgatgctaattttctcctctgtaatggctttcattatcattttcattttttcatcccatgttagatcttgtctgcttgtttgtagttttactttggaaacgtcttgttgtgttctgttattttctcagggatggagtcaagctggggctaccagcagattccatttgagtttggtgtctcagaatttatcagatatgctcttccctggggacacatttcccccaggttttgaagcattcccatgagtatgaggtcagtgtgggtcaccagaaagccccacagattcatgggtcctctgactggccatttaatgtttatgcatctcttctgctgacaagctgcaaggctgactgctgctccctttctcttccacctcacctctaagacatttaagcaatggaggtcagggtttgtactactggctatccacatagtgccttcctatccacagccctgtctcccttgccctttgccttatagaaatgagtcactacagggaactttactcttctatgactcacctacctctcttttcctttttttttctccaataaatgattatttattcagcctttagggatcttttatcttactttcaagaaaatctggtaacatataggactcctctttttgtcttcctctgatgaaacccaaacttcactgaatgtggcagatatgggttttagcctgttttctttagagtaatattagcttctgtaacaactgaacacacctccaaattgcaatggtttaacatgttatatattcatttctcactagtgtaagggtccagtgctgatgttcctggtcagcaggtagatgccatatggtgagtcagaggactgggctccttctcttttgaggggtcttggagtaccctgaattctactaggggaagggcaaagagagagagtagagaaggtgttcccatctcttgaccatgctggcccagaagtgacatagatcacatctgttcacattccagctttgagaactcatcacatggctcaactaaatgcaaaggagtggctgagaaatgtggtccctgcctgggcaattgttccttacccactcctctctattatggaaagacaggaatgaactgtggtgagcagttaatcatcttagcccatagccattttctagttgtattgaagatggaattttctgttatattttcattctttttgttgctttcagtgggtttcagagaagggagtacagtaaacatcttttaacttgtttacaagtatgtcttttccacccatctgtgatctcctctaaatggggaccatgacttaacttgttttctattttccagcacccagcatgatggctgacacagagcagatgcttaataaatgtttcttggatgaaaaaatgaatgcattcctgtcctgagtgggtgaaaacggctcttcccaccttccttattctcaacttactcttcctatcccctctctctcctctctgtaggagaaaggaggaattgtcaggatggctccattcttttttctctgtttccccttcttatcatggtttggctcaaggcttgtgtctcctgtctccagcattgatttacctctccccagaatgaaatttcattctagctttgcctgtggtgcagcctgcttcctgctgcccaaccgtttaacaatgtcctccttgcagcttggggaaagacactggggaaagaaaaatctctctctgtccacagaaccataactcactggtaaggtagccagctgccctatcactccagctggtgttaaaagtcatggacattaagtgggactaggatgtggatcgaacatgtatgaaggagcctgcccaagaggagaccctctcctgctttaaatgccctgatctaagtgggccactctattaaaatccacctacagtggcaagttacttttctaaaatagagagtcctcaggaggaaacatcaacagaaatggagtagaatgaaggagctcagagcatgatcactggaatccaacagacttgtgtttaaatcctgctctgccatttactggctgtatgactttggacacattatgtaagcaatttgagcttcagtttcttcattcataacactgagataattatatctatcctgttgggttgttatgaggatgaactgagttcaattctaggcatgtaagaggcattccatattttttgaatgaataaatgccaaatgtacataatgtaatgcctggcacgttgataagcaatccatataagatggttgtatcagtaatgataggctaggttggctaggtttacaaaagtaccaaattccccaaatcccatgtcttaaaacaaagaaagtctattcttgatgatgcaatatgttcactgagggtcagctggggactctgcttcaagtcatcctgaggctgatagaacagccaccacctggaatgctatcagtcactgtgcattcacattcacaggcaacgtatatttttctagttcttgattccgagtctggtcacttgactgactctggccagtgggatttgaagcaaatacagacttgaacaagcactcacacatttctgcttgaactttgatactctgccatcagcatgagagcatgcctgagctagcctgctggagcaagagagatgcacggagcagagctgagatgcccagtcccccgggccattctaagttagttgacatctaggtggcccccagctacgtgaacaagaccaggcaagatcagaagagtcaaccctagctgaccccagattcatgagcaataaacacttattgtttgttgtatgtagaggtttgggggttgttggttaaacactattattgtggcaatagataactgatacaccctgccttggcttcaagttctgaagtatatagaactctgcacctcttcacattcctcagaaaaaattcacacagtagattctactgacaacttcaaggtggggtctgaaggggtttgacatcacatatctgcatgaatctctattgatcatggtttttctcccccgtttctttggctgagatgctaaccagagcttctctatcactcttaccttatcagaattgtgtacaaagttctgccaacttatatccactctattctctacctgttcatctcccataaaatctcttaccgtttctttcacagaacaattcatccttgccccagatgtggaagccccacattccaaacccaaaaatgtggcaaagtgttttttttgctgttgttgttgtttgaaggacctacctccttaaaagctagtgttttataaataataactcttgtttgtttttcttcatcattagaaagtctgtaaagggcaatgatggtggattattagttctgttatccttagtacctagcaaagctccagaatcattttaggtagttagtaaatgcaattggaaatacacattgttattgaaagaattttagagcatctatatacccttaatatcactctttggtgattaactgagagctaactgtaggaagtaaatactatttatcttctctgtacttgaagaagatatgggacattaatttctgcaagtactcagtggcatgagatggaggagggtagataatgtgttccaggatgggggggtgacacatcatcttcattttatctacccaaggttgtgaggccccagtaggtcatccgtgtccaaagttagaaagccaataagagattgaccggagacaaacatctggacttactctccactgaaccagacattcagccttggcgctagacgctctgaaacttggccgggcttcccacagagcttggcccagggtctccagtggctccattgagcttggcggagcacattgacagagttggcccagaaagactccaggacaacacccaaactccacagtgcccccaccatggagtacttgttttggggggctttacgtgatggagggcagggtgtggacagcccctggcatgtaggctgaagttggttctgacaacccagacctccacatgggccgttgggctcccctgaaccctgctgggctcagttcaggagaaatgctcttgccaatgggcagggaggcttagcattccacccctgctcttttaatcccctctgtgcaggaatgttccactgcagagacagcagagcttgcagagacaggaggtggtgccaaaagggagagagtggtggagaaacagttttgatgagatttagggtggtgtgtgtgcagggatgggggtaggtgctgagttaggctctaccatggactcactgtgtgaccttgaccaagtcacattgctctcggggcccaatttgtttaccttcaaaagatgaggatagacaaaaaagatacaagattcatttctggataaagctgtaaaattctaaaagctgttttacttgtgaagtccaaagtaagattctgtttttcatctacagggcctctcctctagagagatttgtatacaagtgcatttgtaggaaacagggtgtctgtcttaatgggaatatcagagtctacctctcatctcagttctagaattttaagcaccttgaggcaaggtctatgactcataccgcccaggacatagaattcctctgaatgtaataaatagaagagcactttgaggtcatcgaatccaatcttcttagttttagatgggggataatgggaccagagaagggaagttgttctctcaatattatacaatgaatctcaggcccggaactcaggttctctgctcctagaacaaagcttgttccaacaatcgaaaatttctgcctgaaattttgtatacggtctctgaattccaaggctttcagatgcttcctctttttaaaataggcttgactcctccctcctttgggcaactttcaggttaactcagggattgactatggagactataagagtcttaagctcatgtgaagtctgtgaaattccacaggcttaaagtatcccttgggaatctgagagattttgcccaagtagcccaagccttggacagcagcctccctggaagggatgtggctcctgcattatctggtcccaactccagctccaggataggatctctgagctgacataatacggccctattgtaaacaagggagggtcatgaccctccacaaatgactaacatgctaatttgaaaagtctgcctggactagaaaaacaaacaagaacaatgaaatttaaggcaacattttagacaaccaggaggcaaggggaaactcagaaacatgaaaaaaggagtccccaacagctattgtccctttcataaacactcactaagcaccggtcacgtgccaaccaatgcatcagccaacacaagaggaaaacacatcaagccagccctctaagacctcacaattctaggggattagacaagcactcatatggccagtgcttctaggctgtaaatgaaaaatagctttaaacaccatgtaataggaagcagcctcagcccagatttctgtattgaacttcagaccagcagcctgcctaacatcaaccacttggatgtctcataggtaacgcatcttcaaaacagatctcatggtttttcaccccaaatttccactgttctgttagaataagtgacaccatcatttactcagttgctcattccagaaatgggaatcatcctcgataactacttctccctcgttaactcctcatattcattcaatcaatccctaagtcctataaattctaaacatattttaaatatgccccatcttaactgctgcttccctgaaagcaagtcaacatgatcacttttctcaacagactcagaattagccttctagaatccactgttgtttctaatctgttctctgcagagtaataataagactgatttttaaagaaacacacacagttgattgagtcacactcttgcttaaaaagcttcaatgaggacttgtgattccatccatgaataattagctgttacagaaactgccctcccactgatgcaattacttaactgctcatcagaacaaaatctagtattcttgaaatacacacaacaaaatccaccacctaagaacataaaaatcacaatacccagcatccagtaaaaaattaccaggtatgtaagaaagcagaaaaatataacccataaccaggagaaaaatgaatcaacagaatcagatcaagaaattataagaaggttgaatttgtagacaaggaccattaaaaagctgctattaagtcttacaaatatgtccaaggatataaagaaaaacatgaagctgatgaagaaagaggttaaagatgtaaaaggatgctcatagaatttatagagataaaacatataatatctgaaatgaaaaatacatttaagtgaaattaaatgcaaattatatactatagaagacaactgaagttgaagctgtagcaatagaatctacccaatataaagcacagaaaaacaaaacaaaacaaacagtgccgcagtgagctgtggaacaatagcaaacagtctgacattatgtgttattggaatcccagaagaagagaggggagtacagaaaaaattatgaaaatattaatgaaaaaaatgtttccaaacaatggaaattttaaacccaagaagctcaatgaacctgaaataagaagaaaaaacacaaagaaaaccatactgaggaacttatttttgtgtgtgtgatttaagtattttcttgattttctttcaggaataaattcatgtatttattttcaatattttggtaacacataatagatatggacaatgtagacagtaaacaacaaatctaattatttacgtattatcttctgaagcgtagagacttagtgacaggaatgtctaatccattgttgagctcattgattcccaagataaaaataaagtaatagaagcatcggccaggcgctatggctcatgcctgtaatcccagcactttgggaggctgaggcgggtggatcacgaggtcaggagatcgagaccatcctgcctaacatggtaaaaacctgtttttactaaaaatacaaaaaaattagccgggcgtggtggcgggtgcctgtagtcccagctactcgggaggctgaggcaggagaatggtgtgaacccgggaggcggagcttgcagtgagccgagatcgcactccagcctgggccacagagtgagactccgtctcaaataaataaataaatagaagcatctaaattaaggtagttatttttcacctatcttgtctgcactatttatcagtgattctgaaactaagagccctcagacctgaattcttttcgtgttacaaaagatcttctgatatccacttaacatatgttaacctttagcatttgacatttattagtcatggctttcaaatgaagtacttaattaaaatcaaagtgccattgtctttagcaatcctgaaagaactgggtatgaattaaaattagaaaaaaaaatgacagtggttttaagagtaccatagttcctgtgtgaatattgcagttgtttgaaaaattttataaaatattcttattatcaaaatcgaatttaaagtttaatgatgcagtaaagttgagacattcacaaagaaactagaataataacagtaaaaatttagtcatagctaagtgcaatctaaccaaaatgttctggtcaattggatttcgttgtgctaaagactgacaaactacacaagtaattagaaatcaaatattagtgagtgtctagatgctggggttagttagaggcattttatgctgccagatattttttaaaatcacttcttgggtctccttaaatcagggtagataaaattattgcaatttttattttcttgaaaaagttatcactagactatttaatacatgtgatttatacagaatttactctttgctcttttattttccttaagaggtagactttgctttgggttcaaaattaataaataaattagagcagttaaatggtctaacagtgacaattcactgggaaaattaaatctggtattatacacactcaggatctgtacatttctgacccaatggagttaaataaagagttttgcctggccgggcgcggtggctcatgcctgtaatcccagcacttttagaggccaaggctggcggatcatgaggtcaggagactgagaccatcctggccaacacggtgaaaccccgtctctactaagaatacaaaaattagcttggcgtggtagcggatgcctgtagtctcagctactcgggaggctgaggcagaagaatggcatgaacccgggaggcggagcttgcagtgagccaagatcatgctactgcactccagcctgggtgacagagggagactccatcgcttaaaaaaaaaaaaaaaagagagagagagttttgcctatgttctaagtctcatccaaaggggaaaaagagaagaaaactgatggcaaaagtcttgaggtgcttttcataatgtccttaaatgcatcccacccaatgtaatttcatctaaacaaaattttctaaaatcaatctactcatcaggagattggctttattaggaaaactcatagtctatttatttcaaatgcatttttgataaaaatcattgaaatatttttggttggaggtacataattacacttaactaatgtaaaaagcatacaacttatgtacctaaaataaatatttaaattttattgtattatttcagggtagaaatggtaatttttgtattattagaacttatccttgaaactgaaattatattgtaactttttttcttttaagataattttaaaagacttttaggttcaggggtacatatgcaggtttgttatataggtatactcgtgtcacaggggtttatgtacagattattttgtcaccccagtactaagcctagtaccttatgtttattccttctgattttttttccctcctctcactctcctggctcaaacaggctccagtgtctgttgtccccctttgtgttcatgtgttcacatcctttagctcccacttataagtcagaacatgtagtatttggttttctgttcctgcattagtttgctaaagataatggcctccagctccatccatgttcctgcaaaggacatgatctcattttattttatggttacatagtattccatggtgtatatgtacattttctttatccagtctaccactgatgggcatttaggttgattccatcatatctttgctattatgaatagtgctgcaatgaacatatgcatgcacgtgtctttatggtagaacaatttatattcatttgggtatatacccaataatgggattgtggggtcaaataatagttctggttttagctctttgaggaatcatcacactgctttccacagtggttgaactaatttatacacccaccaacagtgtataagtgtcctgcacaacctcaccagcatctgttactttttgactttttaataaaagccattctgactgatgtcagatggtatctcactgtagtcctgatttgcatgtctctaatgatcagtgatgttgagctttttttacatgtttgttggctgtatgtatgtcttcttttgaaaagtatctgctcatgtcctttgcccactttttaatgggttgtctgtttttcttgcacatttaagttccttatagatgctggacattagacctttgtcaggtgcatagtttgcaaatattttctcccactctggaggttttctgtttactaggctgatggtttcttttgctgtgcagaagctcttacgttgaattagatctcatttgtcaatttttgcttttgttgcaactgcttttggtgtcttcatcatgaaatttttgccagttcctatgtccagaatggtattgcctccattgtcttccaggatttttatagttttgggttttacattttaagtcttttatccatcttgagttagtttttgtatatggtgtaaggaaggggtccagtttcaatcttctacatatggttagccagttatcccagcaccatttattgaatagggagtcctttccccattgcttgtttttgttgactttatcaaagatcagatggttataggtgcatgactttatttcttgtctctctatttgattacattcgtccacatgcctatttttgtaccagtaccatgctgttttggctactgtagccttgtagtatagtttgaagtcaggtagtgtgatgcctcctgctttgttcttttcgcttaggattgccttggctattcaggctcttttatggttccatgtaaattttaaaatagttttttctagttctgtgaagaatgtcattggtggtttgataaaaatagcattgaatctgtaaattgctttgggcagtatggccacttcaacaatattgattcttccaatccatgagcatggaatatttttctatttgtttgtgtcatctctgatctctttgagcagtgtcttgtagttctcattgtagagatctgtcacctccctggttagctgtattcctaggtattttattcactttgtggcaattgtgaatgggactgtgttcctgatttggctctcagcttggctgttgtaggtatataagaatgctagtgatttttgtacattgatttgttttctatgctgaaactttgctgaagttgtttatcagcttaaagagcttttgggctgagaccatggggattttctaggtatagaatcacatcaatggcaaacagggatagcttgacttcctttcttcctatttggatgtgctttatttctttctcttgcctgactctcttggccaagacttccaatactatgttaaattggagtggtgagagaggacaaccttgtcttttgccggttttcaaggggaacgtttccagcttttgcccattcagaatgatgttggctgtggatttgtcatagatggctcttattattttgaggtatgttccttcaatacctacatactgaggaacttttaattgaattgcagaaaacagtgaaacaaagaggaatttttcaaagcagccagaaaaaagcgacaccataagtacagagaaacaaaaacaagaatgacagcagacttctcatcagaaactatgcaggccagaagataatgggatggcgtatttaaagtgttgatgcagaaaatgctaaaattagaattctgcacgcaacaaaaatatatttgaacaattaagaaaaaatgaagacttttacacatctataaaagccgagataattcactaccagtagatttgccctaaaagcaatgttaacaggaattcttcaggcagaagtggggagaccaaggtgtagaaaaagggagaccatggcaaagagacggggcagctgaggggcagatgggggacctgagaagggagactcagaaagaattaatttgcagcacactgactttgatctgactgatttagagccttttggtgctgaggcaccctttgctccctgaccagtctctttcatatgtaccccactgttttcttttgcctcttttcctgtagagtcctgaatgttgtcccagggctgctccttctccttctctctgttcccaaattgctcaccccaaccctactctctcttcaccttcttccctggcccctggaattccctagagggcaggacatttctctctgcctgcccacctcccctccccaagagaccatcttcctcctattgtctcctgtgtcagcatactcacatttaaatgcttgctcaccctttaagatgatgtccttctatgacttttactgtttgctgtcctcccttcagtatctgttgaatttttctcatgtgcatacattgcttcaatcatattaatgataaaataatgatgatattgataaaaacccatgatgggtaatgaatgaatgagagaacgcataaagactctcagtcccagactatcacaaatgatgcaagcttagaggatacatgagcggatgtggacatgtttcctagcctcctctggagccaagggcacttgccacacaaataataagggactcatgttagtgtaagtcagaaaaaccccaggccatatggaggaaacgtcagtcatctctttcactcctagacctcaacttgtagtcacttgtgattctgagaagcatgggcctcagcctttcttttcccaaatgctctttgcttggatactcagggccactgtgaaaacacattaggtgcagagtgtcagtctcaaatggaccagggtttactttcagctctgcctcttatttgcctgtgtacctccaggtaagtaaactttatcttcctgggacttgattccctttcctgtgaactgggaataatccacctcttgaggcatctgggaggcccaaatgagataataagtgggagtaactggcatgaaatggagattttttcccttttcctatctgtgtcaattacctccaggtggtaatggtttggcctgctgcctcctgatagtcttctagacaatgccttaagccctggtgccacaacagacccatggggaaggggcttggaggcactctgtctcctttccataagggctcctgggctgttcacttcacctgcctaagcctctgtctcctcaactgcaaaatgggcatcactgtgccacttcatagggccagtgtaagaattcagagggaatttttgggaaaacactttgtaatctgccagtgctctgcagcatagatcagaaactaagacttagagcccttagatgatctgctcaggatctccccatctatgacattacagcttagcattcacatctgacagttggattattagtgcatatgaataagagccaattacatataattgctaatactgtttagtaataaaaaaagcactgtgactaatggagtgtgtgatctgcagcaggcagtggtgtggccacgttgggggctgtcacggcagtctacacggatgatgaagagtatttattactggcattgtttagaaacggtggtgcgtggggataatacaaagcagctcagattttagtaagctttataatggtttttaaattatctgcagacaatgcagccccttcttgcctgcactccaggcggcccattcccaccacgatgtagtaggcagtttcagaactttctctaaggctctgacaaccccgtgcaggaggtgtacttctctgctggtttaaaaaaaggaaactgaggtgcagttgaagacatttttccaaggaagacacagttttaaaaccatcgtctctccctgctgaggcttagatggtctccagaaaagcctcaagggccagggtcttcaatgagccctttggggaccctacccggtggtttggggagagagggctgccccattcatttcacagaagcagcttgcctgaggcaggaactctggggtcccctctggtctttatcactcttgcctccctctcctcaccttcacaccttcttccaagaggaaggcacccaggcctcgacacagccagagagcacaccttaaaaacctttaaaaaggagcaagatgcatgtgctgttggtgagcagctcagttacccctcacggggcccttgagccagccatttcctggcgtgggatgcatgatgactccgtgcggaaggacttttgccgcaggctgcacagcccagatggagctgctttgggggctgtgcacgggcctggcatggaagagagaatcactcgagccctgcggggcagtgatgggaagtggggccagctcctgtcttgcagcagcaagcagaggctaagagcacagaggagctgaggtcccagggcagcgtggctctggccacactgtggttggggccaacaggccttctggaaatgtcccagctgtggctttgttctgtgcccgggggaaaatgacctcttgcaggcccttccaggatgagacagacaacaattttctagataattcaggctccaaaatctctctctgccttcattccaatgattcagggttgttgtgggaattctgaggaacaacttgaacggcatcaaaccaagaataggaaccaatggctcaaatggctgaatccagcaccaaatcccaatattaattttctataaacgtaatacagatgaaatcaaagttgtttttgtttttaaacaaaaccaaacccaagtggatcagttggaacttgcatcaaacctctgcgtgtcctaaaattaacaaaccagaacaaaattggaaaatagaaacttttttgagtgaaaacaccatttcatcaggtttgttgaaccagggttttttttacgcccctttaaaagatagaaaaaattccaaatgtgaaagtaataatctcagtacaaaacattcagaaaaacccaaacagtttaaaaaaggaatatcacctccaatcccaccagtgggatatttccaaagctttttcctttttctttttttttcccccacaactcttttcaatgcatctttttctttcctttttacataaatgggattgttctataaaggctatcttatcttctgctttagttcattaagactgtctcatggagaagttccctatcaatatctagaaagccaagttattattcttaatgttgaaaaagtattccattggacatatgctggtttatttcactaatcggattactgtacaggtagttatttaggttacttccattattttacttttacaaataatgtttcagtgaatggctttgcatataaatcttcataacctggactgattattttggatacattaccccaaaaaagtgtttctaagtcaaagaatatgtatatatatatatgcacacacacacacacacacacacatgtgtgtgtgtatgtgtgtgtgtgtgtgtgtgtatttacttttcatacatatttccagatatgccctgatatggtttggatctgtgtccctgcccaaatctcatgtgaaatgtaatccccagtgtctaggtggggcctggtgggaggtgattggatcatggaggtggttcctcatggtttaacaccatccaccttggagctgttgtcaagatagtgagttcttatgggacctggttgtttaaaagtgtgggctgggtgcggtggctcatgcctgtaattccagcagtttgggaggccaaggagggtggatcacctgaggtcaggagttcgagaccagcctggccaacatggtgaaaccctgactctactaaaaatacaaaaaaagtagccaggcgtggtggcacatgcctgtaatcccagctacttgggaggctgaggcgggagaactgcttgagcctgggaggcagaggttacagtgagttgagattgtgccactgcactccagcctggctgacagagcgagactctgtctcaaaaaaaaaaaaaaaagaaagaaagaaaaagaaagaaagtgtagcacttcctcctctctcttccttctgctctggccatgtgagacatctggcttccactttgccttctgccatgattttaagtttcctgaggccttccgagaaaccaagcagatgccagcatcatgcttcctgtactgcctgcagaaccatgagccaattaaacctcttttctttataaattactccatttcaggtatttctttatagcaatgcaagaatgaactaatacacgccccccatgaaagatcataacaattttcactcccaccatcagcagatgaacatcgccctttctctataccctgcctaacagtgacatgccggagatgctcttcactcttcttctccttccacatctccaaagggagctgtcctacccacagctgtagagtgactaattgtccctgtttgcccaagactgaggtgggtctttggacatgggaatttcagttttcaaaccaggaaactcctgggcaaactggaatgggttggtcaccctacacagcccataacagctgggtggccaggattttttgagtgcacatgctccagtgctgagttttgcctcaactgatcgaaccaggagtggatacctggccctaggatgtctaatgacttggcatggggagacgatctgaaccaattggattcattctcttgggaatttgttttgggaacaagaaaataattcatcagttagcagtgagaaataggtctgaaaggtcattaactaaagggtgaccaataaagtttaaacaccagccaaagtgatgggggagaagaagctgagggtaaagaagaggagctgtttctaagcaagagacagagagaggggcaagcagagtaattgtgttgtgtttatggagaagaaagattcttcaatgttcctgtccatcccaaggctctcttgctgtccttctccagattcctgtgcacctgtactcaaaataactgcctatgcctcttccttcttatcaacttgctaccactggaagaaatctcaattccttgcaagccaagaggtctattcaacactcctgggtatcatccatcactttcacccttgccaaccaatctgattggccaaaatggacttcttacctaattttgttagaatttgcatttcttgaataataccaagttcaaacatcttctcggaaatgcttgcttccaggagttggtctgtgggccaggggcaggtggagaacgaggtacagggcaagactcgctggatggtttgatcaggtgtctgatgccctcttttcttaacctcagtttgacaacctgcctcagctttccagcactgactctggcctggtgacctgagggtggtcctatgggccacagccctacatcttggtctttctggctttttaatcccaggctaacaacctcacgaagattaaacccatctctgctgccgagcaggaagaatttcaccttgactcctcaattgaggctgcctttgtccttggtctttcccctgccacttgtgctctttagttttctcatggccacaggctccttatcatttgggtttcagctcaaatattagctcctttgagaaggctaccctgactgtctcaactaatgtggcttctgcttcatgcactcttcctaatattgctgttttattttctgtatggaacttatcactatttcaaagcatatgattcattttcattgtttgcctcccccaccagatacaagcttcatgggacgtgtctagggtgtcctgctcactgtatccccagtgtgtaggacagtgccttgcaggtgagctgctactgactgcttgactgagctaattaattaatgacagacaaagaaaatttgctgcagcaaaagtggcttggcctcttgtcataatcagcccgagcggggatagctcacaagaccatgtgatttggggttctgatgtatttcccagaaactctgttgtggcatttctgcttgaaactttcagtggctctccactgcaattgaaataccagggctggcagggcttgacctctgttcatctgctcagtgccctctcctcccctttgcccctttctcactcagcttcagacccactggcattctttgagatccttgagtcaagaagctctgtctgtctctgagcctttgcatgcactattccctctgcctggaatgtgcgaatccctgttttatctgcagtccagagaaactttctgtgaccttcataccaaagcttcttccactgggcttggcctctatcacttccacttgctcacttccttcattgcacatgctgtgatagttccttattcatttgcttttagattatgtgcctctccccattctcttccccatgaattttaagtgtcatgagtggagacactgtattttttttcccttttttggtctatcactgtatcgtcaaacccaggacagatgcttggtcattatttattgaatggatggatgaatgaatgagctattctaaaatcaaagccagccactgtaataggccacctctaacatttaactgactcatggttgatcattctgtatattaaattaattcagttgccagaaaatgtctgcattcagtcatcctcaggggtacaccagaaagttataggcttaagaataaacactgtaggctttgtagaaactgttttatgggctttaagcttcacctacattttaaattttctgcccctagttcctccgtggtcaggtacactttcagaggcttgctttgcttctcatgcaagccttcagtgggctccagcatattgctgaagatcatgtgggttctgtctttgggtcattttaactatccttgccttggtggcctgtgcctccattcagacttgacaatatgtcctagaaaacagatatcccggctgggcgcggtggctcacgcctgtaatcccagcactttgggaggccgaggcgggcggatcacaaggtcaggagatcgagaccatcctggctaacacggtgaaaccccgtctctactaaaaatacaaaaaaattagctgggcatggtggtgggcgcctgtagtcccagctactcgggaggctgaggcaggagaatggcgtgaacccgggaggcaacgcttgcagtgagccgagattgtgccagtgcactccagcctaggtgacagagcaagaccccgtctcaaaaaaaaaaaaaaaaagaaaacagatatcccagggagcaccaaatctgcatcaacaccaaaggaaaccatgccaaagaaaataaaatgctactgtacaaatccccttggagtgaccttcccagtaacccagttatgtgtgactacgaaggagggaggattctttccagatgagcttgaggaacacagaaggaactatgtggcttgattctgtacacagctcaggacaatggtctccttgcaagggggagcatcttttcctgaatgcctttagctgataaggttagcttttccatggaaaagtggccaagcctcagttgtccaaaatgggtttggatttcagctgaaatcatatctgtttaggcagtgagatctgaaggcccctcatgctaagtggaaagggcattgtacaggagccaagagacccagactctagtcttatccagcaactgacagttatgtgactgtggtcaggtcacttccactctgtggacctcagtttccctatctgtaaaatgggagtttgtctggctggtctctaaggaccctttcataacaatttcagtggttctcaaccctggctgcaggttagaattgccttggggagtgggtagagccaagccaccagcatttttaaaaaatgcccaagagattcagaagtctggcatattctggaatgccagcccatagcagatgacaagactgaagactgtggaccagctgagactttcagtaacttttcttttttttttttcttgaagtgtctctggcaactctagataactagattctaagtatagctcatgacctgcatatgagctatttaacaaactcttctaaaatgattacctaaatcttgttgcgaatgccaccccactagacattataatctctgattaagataggctttgtgctgctacttcctggctgtatgaaattggaaaaattctttgatcttttgtttcctcatttacaaaatatgggcactatttgtacctcttctagtgtttctgtgggaattacatgaggccaggtatataaagcatccaacatcatacttagcatatagtagatgctcaatgaatgtaagttcttcccgctcatctcccatggtatttagtttgggtatctttgcatggaacaactttccccgaagtatgttctgcggagcgctccttcccccaagatgcttcccacaagataataaaggaattttatgatgaaatacattaggaaaacctacatgccacagtctcttcttgaagtggtattcagtaatgtgctggtaagccagctctctgaaaaaaacaaaaacaaagcctcagatatgtagcgtttgcttattttcatggaataaatactatcaccctggccaagtccaaattaccaaatttgtgtcactgaactataagagctggttccagcacactactaaagtaattgttggcattttctagtctctggtatgtcctgtaataaatacagctgtttatttagctcagtgtttcccaaatgtatggaacccttttgtctcctaatacctcttgacatcctatggcactggtgtttcctgaaacacactttgggaattgctgatgtgaaataacgtaaatatttgttcgtttctaaaaattcatcagcatgctaccatttttaaaaagtgaaagatggctgggcgcggtggctcacgcctgtaatcccagcactttgggaggccgaggtgggtggatcacaaggtcaggaattcaagactagcctggccaagatggtgaaaccccgtctctactaaaaatacaaaatattagccaagcatggtggcgggcgcctgtaatcccagttactcgggaggctgaggcagagaattgcttgaactcgggaggcagaggttgcagtgagccaagatcgtgccactgcactcctgcctgggtgacagagcaagactctgtctcaaaaaaaaaaaaaaaaaaaaaaagtgaaagcatagtctgcacaattaggagcagtgtgcaaggaaagaagtacagaggagacatgagacagcacacacaaagtgattggtgaacaacagctgtgctggaaccaagtactccacggaggctttgattgtcagtgcagagaatgagcccagaaagagctagggaatcctggagagccctctggaggaggtggctgtcagctgagccttagagcactggagggcttgggaggttttgaagaagatcaaaggagagaaaggatgctgcaaatgggtagagcccacacaaagatgtggatgggacaatgaggctgtgtttggtgatcctgccccaaccccatctgatttccttcagcgttttccctgaagcagttggtgtacccatctccaaagagtaaagttcccacttgagtacctcatcccttcctgtctgtctacttggacatgtgtctgtgtgtgtctttctgaaactgggcacatatctctgtgtatgtgtgcctgtgtgtcattcagagggctccccaggcaactaggtatgtgggtagaaccactgagaacttcagtttaatgttcttgggtaggagaagcttctggagctcaccatggagcctaaactccataatgaaggaggaggccattcctctgtccagctggcaagttttgatgtttaccctagggccccatgtggagctgaaggtggccccatcaaataataacatagctgttatttttgtttgtttttttgagacagattctcactctgtcacccaagctgaagtgcagtggcatgatctcggctcattgcaacctctgcctcccaagttcaagtcatcctcccatcttagcctctggagtggctggaactacaggtgcacgacaccatacccggctaattttttgtggagacagggttttgccatgttgcccaggctggtctcgaattcctgagctcaagtaatccacccatctcggcctttcaaagggctgggattacaggtgtgagccaacacgccctctctgaccttttttttaaagtgtggtaacatacataacaaaatttaccattttaagtatttttaagtgtaccattcagtagcatgaaatacaggacactcagattgctgtacaaccattaccaccatccatctccaaaactgtttcatctccacaaactgaaactctgtacccagtaaatactaactccccattcacctctcctattattacttttgaccactccttgggtcctaggcagtcttctaagaaacttacatatatcaactcatttagtcctgttataaccctgcaaggtaactatctgccctttacacatgaagaaactgaggttaagcagcttgcttgagtccacagagctagcaagtagcagaccagattgagagctcagctagatctgacccctgagcccacgatgctatactcctgcctgcttcagggaagtctgaactcacctaagattcagtaagaagaaagacccctgtaaggtcccttgagtctcctgggtagatgaaggctggaagccctcagtgtttggggcccaatatctgacatcaccaatctctcccatatcgggtgaatgaggccccagccatggtgatctggggtagtcaggtcaccctgagcagtgagggctgtgcatgtggctggaatggatgctgcttctctgagttgtcagccagacatgtccaggaaggagtgggggaccaggtctggcagtctcagcctctgaggtggctctttattctgggggtggtggtgggggttatgggtgatgtcagacttgggcaagctgagggctggggccaggaagcggctggcaagacaagctcttggcagagatggctcactctgcacttgagaacagccattgctgagctgaatccagctctcaagagtggtcaagctgaagagtgtggagagaggtgaaggattcttggctgtggagtcagactgctggagtctgactgacaaggcctgtcaaacgccttccactgcggatctgacttgaaatgggagctttggtctcagtttctgcatggaggcctggtatggcctcaccccgtggcggcctcatcttaaacctttctgtttgtgcacgcaagcatgcatgtatccatgtgggttcaacaggtttaagaatgaggctctctgtagctatttcagatccaatcacgtcaagcccagacagagatttaaggcgactagcttgtgttgtttcctgtcgaattccttggccttcttggaataagactcataaggttagtttacacagccaggatgtctttcccagctggagcagggtggggtggagattgattggtgctgtgctactcccagtctggcgagtaggcagttactatggaggggcccaggctggggagcttacggccttgcttcccatattctcccacatccccttctagggccctccctgctgccttgccctctccatcagaatcaccccagattctgctccaccaagtccaccatgatctctgctatgtccactgtgtgctttaaaggaacacttctctgacctcaatgctctgccaagggaaagactccaaactgcttctttgagcaaggggtggtcactggtaggacccgaggtgtgcccctgacctggaagcagccaagcatgctatgagacaagtactgtctcatagtccttttttcaaggactgaaaaaaaaaaaaaagaaaaaagaaaatgtagaaaaggcaatccatatattggcattcttagccatagactgtaacaattgatttatatgttcaaggaaataaatgaaaaagatggaaaatttccacatagaagtgaaactgaccaaaaaaaaaaaatcaaccagaaattccagaactgaataatgaaataactcattttaagtgtccaagagataggtttaacataactttagacacaaatgaagacaggatcaatgaacaggaagacagaaagataaaatacatgtgtgactgatcacacccttacaggtctcccacaactccacatgacttacctaccggcacccagcgttccttttaatattatactctcctgtcccatttctcctctacatccaacttattctttacccacataagaatgactactctctgttcccaaacatgctatgcatattcttgcttttatgtccacttcttattccaggaagtcttgacttccatttttatctggtcgacagatcagcctcatcttccaaggaccagctcagacatcaccttctctatgaagccttcctcaggcttttcctggttcttccctcatcccctctttgaggtcctggggaggaggggatcctctaaaacagttcttagcaccacatactaaaattactcaatatgtctatttctctcctagaataggacttcaccaacggtaaggtacatgtgttattcatcttttgcgtctcagttcctggcataattcctagcatacagttagtattaaatattataaggaagaatgcaagaaccaaactcttttggagcccacagataagtatcttacaacctttgataaacgaatactggtgaaactgtgatttggtgtttaaaatctcatttgtccatttgttcattttccccaccactccaccagaatataagttccatgaagatagggattgttttgtgtgtggctgttctgttcaccgttgcatccaaatgcccagcatatagtaaatgttcaagaaatgaacactctaacacttactgaggctgggcatggtggctcacacttgtaatcccagcactttgggaggccaaggtggaaggatcacttgaggccaagagttcaaggccagtctgagcaacacagtgagacaccatctctccaaaaaaacaaaaaagaaacaaagccaggtgtggtggcatgttcctgtagtcccagctactcgggaggctgaggtgggaggatggctttagcctaggagtttgaggttatagtgagctatgactgcagccactgcactgggtgacagagcaagactgtctcagaaaaaaacaaaaaaagagagagagagaagaaaagaaatatttattgaatgagggaaatagtctttctaacaccctggaggggaaggggggacaaggggacagctggctacccaatttgggcactttgagtctgctgacaattggatcccaggaagcaggtagatacccagagcagagaggagaagctacaaactttgaagaatagcctagtaacttagcacacactctggaatctagtcttttcagtttaagccctggtttcagctatttaagggcaatggtagtaccggccccatgtgctttttgtgaggatacactaagatctacagcacagagcatgggatattgtacccactctactattggttaccttttattgtattgtttgagtgtgagtccaacctgggtttgtcttctggtttggtcacagattgctctgttgcgtctaaggcctttgggctccaaccccaacctcaaacacctacccagggctagcagtttatgtgtctcttctcatttgaccctcattacatgccatgaggttgatgttattggtgctggttacggtggaggaaacagatgctcagaaatgcccaagtgacttgcccatgtgagaagtatcaaaattttaaggtaagtcctttttgctatccaaggcccattgcctcagcctgccttgccccgaatcacacttggctgaaccaaggctagaacctaggtcctcaggacctccaaatagtgttattttcactgcccagtgaatagcagtgttgggattctcactgatcaccaccactgtgctaactggctggaggaaactgaggaccagagtccataaacccggccttgtggcctcaaagcccgtggccttcccaccccacaggtggcactttggcagctctcagtacaaggaaactgttgttattattattaggcattgcctgacttggcgcccaggcctaaaaagaactcagcatgattggaagacccagagctcagaagccctctcccaagggctcctcttaactgccagtggggacattgctcttgcctctacccccacctctctgcaactccttcccctgccgttgaaatagctctgtggccccagagaaaggggaggaaacagtcccttagtacacacgttcacatccaggttcttgggggctttcctttgcctcctgggctctcagagctgcagctggagccagacaatctgtttctcattagctgtacttttgctgtgaaatgaagtgctctttgaacctgtgggagcaggaaacccatttacacccttgagaagacagggacgtcagctttgccagcacattccttcggctccttttatctcctgggtggagctcccggtggtgggcaggcagctgctgctgccacctcccctggtgcagccatgggtaaaggtggtccatggggtgggcacagaggaaagaggggatcatgcctctctctcacttggggtaaaagaagcacattctgactggagttatttgccccctttccctgcctccatcttgctcctgataactcctctgtcccaggtgtcttcaataaaacccccagaaatcatccatccatccatccatccatccatcccaagggcaacttgtggatccagagatccagaaaatgtgagaacaaagagaatcctttgatacaacccatttcattctcctttattttatcaatgggcaaattgaagcccagagagttaacttgttccaggacatagcacacttttgaattcattttacaactatttattgagtgctttttatgtgccagattccccccagctcccactggtggtacagtgtaaatatagctgtgaaaacatgcacttttctcagccttcattatcattctagtgaagggggcagatggtaaacaactgaacaattaagtaaacatgacaatgtcagatgataaatcgtctgagaaaacaacagaagtgttgagaagagtgagtgggagcagggaatgctttagatggggtggtcagggaaggctttctgagaaggggacatttgaactggaacctgactgatgacaaaatgctggctccaggaacatctgagggtaaagccttgcaggcagggaagtggctggtgctacacagtcctgtggtaggaaggagcttgtttaacttgcttaagaagcagagagaccagcatggcaggagcaaatgagcgagaggaagagcggtggaagatgaggccagacggttcaatgcatctcgaagggtctggagaccatgtaaagagcttagtctttgtccatttggaagccatagagggttttaagcagggagttgatgaagtattttcccaagcagatgcctttggttgtgtcaaggggaggcaggggacaacgtacccacagggtggtgagttggggttgcctaagtagactaaataaacaacgatggtggctaccagcacctctcccttgacccttgatggtgtaccaaggtggagaaaagacagcagagtcgggaaaaaatttggagatcgaatcaaagagtccacataatttgcacatggctcggatacaggctgtgaaggaaaaaaggtgaatggagggttttaggttgagcaacctgggtcatgcccctcactgagatagagaagaccaagggaagagtagatttcaagggggaaatcaagagttctgtttgggtggattaaattggagatgtctcttactcggacagtgccaaggagtcaggcggatagaagtctggaattggtggccgaggccagtttcccacggggctccacccgtacccagatgcctcacaggggtggggaggaagtgttggctctcacagggccatccactctggacagctgactcaaggctgctaagaagtcactgccagtcccccaaaccctatctctaggctaggaaggtggctttggagctgtcagcattccagttggaccttccttctggagtccctccctagtaaaagcagatctagctaataaccccagaaccgagggcgggagtaggagatgtgaaatatgggaataataataaaagcctatgttacgagactgcttgtcttggtcccgagcttcttcataaataatcttcacctcaaattgcctacacactatggcagatcaacaacatgggttcaactagctccatttcattgatgagaaaatggaggttccaaagaattgagtgactttcccaaggtcacgcagatgatgaatccaagactcaaacctgagccctctgagatcacacctactgcgccctgctcaatagtaagccatctgccgccagaaaggtcttattttgagagagccagcagcaagggctctggagccagatcaccagggttcaactcctgacttgaccacttgaaggtaacgtgagcatgggcaaattagtcaacatcacttgcttctgtttcccatctataaaatggggacaggaagagtgttcacttcagaggatcaacatttataaagtgcttagaacagtgcaggaagggctatacatgtgttggctactactgtgctcattactttcatatacactaaacagagacgtggggactgcctagaatctggagagaagatccagccctctcatgtaagatatggagaaactgaggcccagataagggaatggaggcagcctcttagacaagttgggcccaagaatctggctggtggaggaactctccctattctctgaaagtcaccccaagccagactattttcaggagatgaacttccaagctcgatatacccttaattcatgtggaatttcagctctgggctcggctcccaggaggagcccctccacccctttatgaaaatagagcggagtcattcggcaaaacctcaagctaatgcttttaaggaactggcaggttgaaacaggaaactgttctaagtagaaaccacagaaacagcacatgcttgccgctgccggctgccgcctggatccttgccggaggccccagggataggggagctgtaggccgtgccacgtgagggggcctcaggaacctagccctggtgctgctgaccgtacgtggccatgtgacagcaaatgccacgtcttgtgggcatatttaaaggtcaaagcaaggtggggtggtaaccaacaggctaccagcattagacacacagaaagctagtgtcggagcaaacctgctcctttctatgcaagcccctcatgttgtatctgttaaaactgaggcccagagaggggaagaaactagtccaagtcatccagcaaggagtggtgaagcaggataggaaatctagactttctagcacctaagccaatgctatttaacaacagtcagtgcatttcctgccttccatccattcacctcttccaatatagggtacttttctgttttgttttgttttgttttgttttgttttagagatagggtcttgctatgttgcccagggtggcctcaaactcctgggctcaagtgagcctcctacctcagcttcccatgtatctgggactacagaagggtaattttgtaagagcataaattccaggtcagaagaccagagttcaacaaagactctgcctattcccagctgagtgatcttaggcaagttacctaacctttctgtgcctcagtgtcttcttctccttttcctgttaataaaatgagggacagtaacattacttatctaataggatttctggaaggattcagtgtgataatctatatgaacctcttcgtatagtgtctgacaaatagtaagagctcaataaagtttttatttttttcatgtattaaatgcccagtaagtgacagccacattgtcacaaagagatcagtcaagtgtcggggacagagagagtaaattttgacatgtctagaaatggcgcaagagagggaaggatgccattaggactctggcatcctgaaaaacctggccccagggaggagagggctgctgagaggagtaggccaaacacctcttctgggccgagcgcggtggctcacgcctgtaatcccagcactttgggaggctgaggtgggcggatcatgagttcaggagttcaagaccaccctggccaacatggtgaaatcctgtctctactaaagatacaaaaaattagccaagtgtggtggtgcacacctgtaatcccagctacttgggagactgaggcaggatcgtttgaatctagaaggtggaggttccagtgagccgagatcgcgccattgcactccagcctgggtgacagggtgagactttgtctcaaacaaaacaaaacaaacacaacacaacacaacacaacgcaacacaacacacctcttctgtgcagagatgagaacccatgcccaagggtttctttccaccacagcaggttttttttgctactttggaggatgatcccagtaaagcatgccctggtttcctgggagtggggacacaatgcacagggtcatccccactccagagctggaatgccaactgaggccataaaacaggatttaactatttcttatgaaacttggcacaaacttttgctttcagtctttagaacaattccccgtccctccactccaaagatgcctatgtcctaattcccagagccagtaaacagatcactttgcatgccaaaagggactttgctgatgtgatgaagtgaacgatcttgagatggagagattatcttgcattctacgcgtgggctgatgggtccgtgaaattaggaggcagaagagtcagagtgagaggaggagatgtgatgactgaggcggaggtcagagtgacctgaggcaggggccatgagccaaggcatgcaggcggcctccagagctggaaaagatcaggaaacagatcctcccctagatcctccagaaagaaccagccctgctgacccagtttagacttctgacgtccaaacaggaagatcataaatttgtgttgttttaagccactaagtgtatggtcatttgttatagcagcctcaggaagcaaatatgcttagtcaatatttagtctgacgttggtcactgtagctctattctccgctatgtgtagtttgagtcttattttttgcataatccccaaaatacgtaaaagctcccctgagcatgacatacaaggccctgcttgctctggctccttcctggtacatgcctccttttcatcttttttatcctaggacagggtcttggagaaaacaggaatatgtaaggtgtgccatgtgaggtctagtcttcatatttcccatgaaatattcaataaagtctagataataataactagtaatccagtatagatttttattttttttttgagatgaagtctcactctgtcaccaggctggagtgcagtggcacgatcttggctcactgcaacctccgcttcccgggttcaagagattctcttgcctcagcttcccaagtagctgggattataggcatacgccaccacgcccagctaatttttgtatttttggtagagacagggtttcaccatgttggccaggatgttcttgatctcctgacatcatgatctgcccgccttggcctcccaaagtgctgggattacaggtgtgagccaccacactcggccccagtatagattcttttggggtactcagaggggatccgaactctatatccatatgggctttacagtgtcatgcccacaaaatgtggcattgtgatctggctgttgatgacaacagctctcgtctcctatctctgccactccctagtgcatctgaatcagccttcattttcatgtatgagagctcatgttttgcaagggggagggtgctgggatatgacatgggttggagaaaagaagcttgaacgggacaaaatggatctggacttccctggtctctttgtctgcattacatcctcaaaggccaggagggcattagaggaaaaacctgaagaaactatttaagggcaacggtgacactcttgtttcagctgaactggcctcttaagtggttcctcagcctccattcttactatcccacaacccattctcaacaaagcacccagaagatcttctacagatagaagacagaatcatttgcagtcccttccctgtctagaaccctccaatgcttgcattgaaactggaatgaagtttttttttttttttccccaactgttactttaagttcagggatacatgtgcaggatatgcagcttccttacatacgtggccatggtggtttgctgcatggatcatcccatcacctaggtattaagcccagcatccattagttattgttcctgcagctctccctcctcccacctccaccctcctgcaaggctcagtgtgtgttgtttcccccatgtgtccttgtgttctcatcattctgcccccacttatacgtgagaacatgcgttatttggttttctgttcctgcattagtttgctgaggataatggcttacagccccattcatgtccctgcaaaggacatgatctcattccttttaattgctgcatattattccatggtgtatatgtaccacattttccttatccagtctaccattgatgggcatttaggttgattccatgcctttgccattgtgaatagtgctttgctactgtgaatagtgctgcatacacatatctttataatagaatgatttatattccttggggtatacacccagtaatggggttgctgggtcaaatggtatttctgcctccaggtttttgaagaattgccacacaatggttgaactaatttatgctcctaccaacggtgtaaaagtgttcttttctccacaacctcaccagcatcttttgttttttgacttttcagtaatagccattctgagtggcgtgagatggcatctcattgtagtttggatttgcatttctctaatgatcagtgatgttgagcttttttgtgtttgttggctgcatgtatgtcttcttttaagaagtgtctgttcatgtcctttgcccactttttaatggggttgttcatttttctcataaatttgtttaagtatcttataaatactagatgttagacctttgtcagatggatagattgcaagaactttctcccattctgcagggagatacctgtatacctacaaccatccgatctttgataaacctgaccaaacaagcaatggggaaaggattccctatttaataagtggtgctgggagaactggctagccatatgcagaaaactgaaactggaccccttccttacaccatacacaaaaatcaactcaagatggattaaagacttaaatgtaaaacccaaaactataaaaaccctagaagaaaatctaggcaataccattcaggacataggcactgacaaaggtttcatgatgaagatgcgaaaagcaattgcaacagaggcaaacattgacaagtgagatctaattaaaccaaagagcttctgcacagcaaaggaaactatcatcagggtgaatgaagtttaattgcctatttctccagcttcatctcccatcatgctcccctgtgcttcctgtgctccggccataccagctgcctctgggcccagcccacatcagctccttcctgtcttagggcttgagctcttgctcctctttttagctggaaagccctcccctccagacctctgcatcttggttacttcacatgatttgcatctcggctcaaacatcagtttctcagagaggctgaccttgaccatgtatctcagtttggcttcctgccaatcagacaccgaaagagacttggtataggtggattatttgcaaggcaatctcagggagcacaagaggttgggggagtcatgaaagtatgacacagatgggtgtgttaacaggatgtgttactgagttggttacccttgagggaaactgagactcagtcttgttggagacccctgaggtatggtgtgaaacatgcctccaaattgtcccactaagagatagaggagttgaagtatttatccaacaggctcttgccctcatgggttgaaggttgccctgggggtgcggtgggtagtcagtccctgtgtgtgggcagagcacactcctgtggcaccagagaaagtcttcagaaggagaagaggagatgcaggaaagcaatgtctgtctgcatgcctgggaactgaccacagaaggtgccagtgagctcaacggtgggcccaggatacgtggggtggggttaccccatcctaactagtgcttctccagccagacagttttatttattttctttttagttctgaactctgtctgaagttgttttactcatttattcagctatccatttgttaattgtctgttccccctacccacaactagacgatcagctatacaagaacagggacctctcattctaggtcaccatcctctttccgggcttgagagcagtgcatggcacaaagcagatcctcaataaatattaaacgaatgagtgagtgaatgaatgaatgtactacttcacggtgtgggggcaaaagcgtgatcccgattcagtggacagttgactccatgtggatgatggacatggataagttgcagacagagccagtgggagaggaagaagggggctgatacccacacataattacagctggtcacctgctttgtgggcagatgggaggcaccttcaggggatcctccaaagtaactgggaactacagtgatggggactgaagtcccgctaccacgcatttagaaacttccaagccagcagtcactgtattagtaagagtactgatgtttgtacaaatacttcctcttttaataaattagagtgggttcaaggttacccccataatgacatcactctcactgacttgcaatctaatctattttcttgagtgggagagaaaaggttgaatttacagcatccacttgctcagcaggcatgtgaagtatgatccattttcactgtgcttcactagggcttgtgttgaaggtcattggaatcccttctcttccattcacttgctgggtgaccttgggcaaatgatggtaccactttgaccctcagtttcttctttcttcatctacaaaatacgagtgataaaactaccctataggggctgtagtaaaccttagtagtacttaatagtgtgccctaaacataggcagtcgttcatagataatgactgctttctataatactactactaatgctcacgagatggatgacaatgataaaggcttagattttcatgagggcaatgtgcagactctagactatttccctagataagtaataatagcccttgagatcagagcacatcagcactatagaagtcacctagtctaccgcccttagacaaggacattggctaagacaaagaataaccattgtaatggtggctaccatttactaaatgcacaccttgaatatatttcatcccattggcctgactaaacctactgtgaggtggctgcatcagaccatataatggtcgggtaccattaagcatgtgctttaattggttcccatcacttcgacactcggcttactgagcagccacctgggtaagctctggcttcccatgtgcttctgcctttagaatgggctagacactgcagattccaggatcttcccatttcagctgattttctcatcatgaatcaatagactggtattctgatctccatttgatttcctacataacttgatgggagaggatgagttgacagtgtgttcaagaggattctggtctaagtgttacttaaggttctcatctcacttttacagacaataatattgtgagtttgcttatcaagtatcccgacctgaatggtgtacttcctcaggatttgctgaaaaattcaggttctggcatctcttgaggcacagaaactgtgaggtaataagtgggtgttgtcttgcaatgctaaatttgtgataatttgttacaaagcacacagaactaatacagatctcaaagccttccgtgtcttacctttacctacccaacacatcacttgccactctcccttttgccatgttttggtttctagagtgccctctctggttgcacatgctgtatctctgcctggagcacatctgccacctcacctgcaacattctgtcaccctgtatgtgtcaccacaaacatcactttccaggatggcctttcatgaccccctggacaaggcatgtcaccagattgcacggtcccagagtccctgtgcttttctctccatgacactcaccccagaggtgattgcttgtcacctggctggcctatgagctccacaacagcaggacatatctgcctcatccacccaggcatccctagtgctcagcccagctcctggcatacagtaagtgatcaataaatgtattttcagtgaaacaatgactccaatgccacgcaggggaaagagtcttgggttgagagtcaagagctgccctttggtgtgtgatttcagttctctggccattacggcttcagatgccatgccaggactgggattcaggacacttgggggttgggggcatctttgcacccaactttactgggtgacctagaaaaagtaactttttttctgacacctccagctccacaatctataaatctgggatgaagctgccagccgctctttctggggaagctgatggaggacaagtgaggtcatatccaggaagttctctgaaagatacagcttcataaaagcctacgatcaggcttttagatgcaagatacaacccaggctcttggcttggccagcagtgatgtcaaggccagtggtgaggtaactaccaaggctgtggggccttgccagcaagtgtcatggggtgttgctccccagcctgtagcccaaagtctgtctttatgtctatagtagatgcaggatcaagaccaggtatagagacttgtgggctaaatcctccacggttaatgacaaagccctttacaaggcttccaaatgtttctaaatatatcaccaagaggcaagcaatcagaggcagtagcatgatgtagtagaggccatatggtgtgatatttagaactcaaggctctgaaagcaggccacctacaatggaaaaccagcttcactgctcaactagctgtgaaccaacaatgtctctgggcctcaggtttctcatgtgtaaaatagggatcaattataaggcctatgtgcaatgttttgaggcgactgagaaaatgcatgcaaagagcttaacatcgtgatcagcacagcaaaaaatgtttaatgcatgctcattattattgcttttattattgtgttgttttgtttgtactaagtccctgtagagatgcaagcaccttcacttgcttagtactaatggtgaacctctgtttgggaagtattcccaatgagatcttattctctcatttgacagtaaggcagggacccatttgtggccaaatcatggtctttctcaaagcttcatccccagcacttaggacagtgcccgacacacagcaagcctgctgaaccaatggatttaatcagatctactcaagaactctggaggcagtggttgttattggtgtaattttccaaacgaagaagcagagtaccttcaccattattgtgaagtcagattctcacctgctgaactccaaatccaaccctttccactaccttcagcttcctggtgactccccacactaacctagctcagcaagatggtgcaggcagcagagtgaagtggtaggaccatgggctctggagccagaaggacaggttcaaatcccaactccactgcttcccagctctgtgaccatggatgagtcattcaatctccctggacatcgtaatttcatctgtaaagtgaggattaacagtgtctacatatcctatgaggtaaatattactgcctgcttgacagatgatgatgtttcacacaggtgagcccagtcactaaagatcttaaggttcctgaaggtgggaaccatgttcatttacttcaccagacgtacttagaacttacagatggaaaccatatttactgaccatccactaagttccaggcaatgcactgggggttttacatatgctgtttcattgaatcctgcaatcaactttataaagctatttccataagtcttatattatcctttggaaaaaatcaaaacaagacaaaaatctgaggttcagagaggttaaaaaaattgtccaggtcttcacagctgataagtgattcaaactcaggatagttaaactttaaagtcatgttcttctccccatgccatggtatctttcaataaagtctgcccctggagcacttggagaattggctgatccctttacacagtggctgagtgtggggggcaaaggcaatggaaggaagaggctcccagattttcaactcttgagaagtctaaatctaatgccacaaagcgaaatttgattgaaggggatcacagcagcatcagcatcgacagaactttatcttacccaaccaggatttgtcaaggggtggggtggaaagaggacagccatatcacacaattatgatgatgcatagatatttcttgggcctaaaatgctgctcaagtcctgaggggaacagcatgaatacctcattgtacccatggaggaggaactaacaaagacgtcttatcttccagcttcctattccaggatcagaattatctctgacattctgggctgttgtgagttctcctctggctgtctgagcccaggagagtggttcctagtagctggctcttggtttctatctgatgtctaacatggccggcgcctggcggagctcagtctttgccatatctgtggcctccttaaggcaacagccttatcttattcatctctgtgttccagtgtctggcagaggggttggtgtggagcccaaactcacaaaatgctgaaccaaggcccaagagtttggccaagtacaaatggctgaaagttcatgtgatgctcttgaagccctcagtgtagacatctcagatgggcccagccaggatgctgactgataagagctggggggtgggttttgaggtaatgggcagtggccttcatgaggacactctggacaaggaggggcattataggatcacagcgccacacttagtcaaagcctggtggagaggacagagatttacaccagggaaaccaaggactgacaattattcaaaaggaccaaaagccaggctgagccaagcaaagagccaagactctaaaggagaggcaatctgagcaagaaaaggtccagaactaaacagactgtctagggccactgctgtcatggtctgtgggtgtattaagcagctgagtctgctgctttaaagggcctggggtgggtggacagaggcaatccctcatctggtgtctgagtgtcagcagcttggaggcctctttgcatgtgggagcaatcggaaaacttcctgagccctgattaggctggttaacagtatgagtggatacacgcatgcaggatatatcttacagggtgttcttagcctatggggccaacaaccttatccgctctatcatcttaaccaccaccttcatctccaggtgcaggggggagagagtatgggcagctgctgttttgtacacatccccggctgccccagccttcacgcatgtgacccgagggatgggggcagagacactgatccaaggttaaccaggtctcttccctgagaacttggaatgggtgatggaggagcagagaagaggcaggcaggcagacagacagacagacagacatcgccctgggaggatggccctgtgatggctgccatgcttcctgctgcatggatttgggaagcagcggaaccccatctgcagggacagagaaggataaagacgacacacagagtggggctgagatccgagatgaagagaaagtcctgacagtgtttgctgattctaggacattcctgggtttatttgtgcctctggattccacaggacattccccctaggtcttgggctaaatcctcatggaaccatgcttacactggtttctactacctgttatccaggagtccttcctaataccctgtgtatccctcatggcctttgactctccccaattcaatgttgcttctcagggtggatacagtcttcggcatccattctattctccttctaatgtgcctacctgttttggaaggatcacaaaaagctaaatccacatacctagactttttgggagctaaggctccaggggtgatttaggcttcccaatgaggggcaattgcgcaggatttgggggtggaagtgagaggtggttacactccatctgcctccactgccaccaatgggttcttctgtggaagtgtttactgagatcctcgtttctggtccctggctctgtgtgtgttgaggggcaggatacaaggcttttggcaggctcctggatcagatggagtgggatcaagccccatatctgcatttctagctgtgagactttgggtaaataactcatcttctctgtgccctaatttcctcatcagcaagatggggatagtggtggcacctacatgacagggtagctgaggtaatatatgtaaagtgcttagggaagtacttggcacgtagtaaattctcaatcaatgctagctattattattactatcactactattagcagatcaagcccacaatgttgcggtgggaagcaaaataatttgtacgaatgacctagtgcaggctggaacatcattcctgtatttgtttgtttgttttgttttttgtttgtttgtttgtttgttttttcccccagcttccctgcaaatccagccctggaatttgacggctctggaaattctgattatctagaaggggatctgtcttagtcccaacatgacagatcttcaagcatcaccatcagctgactgccctgaggcctcccacgctgactcctgaaacacggtcagcagcccctagcagccagagaggtcattgggtctcccagcccacagggaggctggtgacattttcatccttttatgagctaatatcttgggctcccactcatgtctgggaacttgaaccactccagcctgcacccttatgttggtttgctgacaaagcagagagcttaagctggctgacccgagggcagagaaagggaccaggacttgtggaggaagaggcccagaggcagggggatggcagcaaggggctcctgcccaggaagctctatttggtggggagaggagggggccatgcctggcaggatttcctagaatcagaggtaggctcatgtagttcaaccctctcattttattgtgtttttgtttcttaattttaaaatcgactttactggagtataatttacatgcaataaaggcatcagttttatgtgttcagatttcacacatgaaatactaatggactaatggatacacatatgggaccatgaccacaatcaagagatagaacatttctaacatccacgaaattccctgatgcccactgtagtcatcccagatcccaggcaatctcttatctgttttctgccactgtagagtaattttgtctttgctagagtttcatataaaagtgcaattatgtgcaactggcttgttttgctcagcatgaagtttttgacactcatctatgttgctgcttgtatcaacagtttgtcctcttttgttactgcatagtgtagagtacttaccccattattttgataatattatccaacattgtggattcatgtcagacaaacacagtgttaatgctttgtataattttttttctctgggtccccacaatgatcttatgagaccataaatggaaaaaactgaggctcaggaatgataatataattgtcccaaaacaggcaatgggcaaaaaaattaaaacctacatttgaaccaagacaatctgagtccagaatctatgcccttaagaatcatgctgtactgtctcctattttacagactgagaaacagagacaggaatggaaacaatttgaccagcattatattgtattgcagcagaatattttgagaatctaagggctcagattcctagcatatcatgtgacttcctttaaaacgggcctaaagaccccaccaaccccttccttacttgcctgaagcctgtgtattcttcaaatgctctcctattcttttttcactaaacatttaccagctcagggccaggcataccagtaagcaagcagacagacctctctgaacataaatcaatgggtccaaaacaccagccacagaaaaacagaaaggggagaattgcaaacaacagttcagaatttttgtgtgtgctaagttcaaaatgttcagtgacggtgtagacccaaagggccaattggagctgagctcccaatccaactaatttttatagaacagtcttaataggtcagctcagtcttatagactgtcatatttatcacccaaacctcaaaacaacccatgaggttaggtacttgtattctcctcattttgctaaaaaggaaactgagggttggtgaagctaagtgatgtgactgagccattcttctggatcttttcttttcttttttttttaattatactttaagttttagggtacatgtgcacaacgtgcaggttagttacatatgtatacatgtgccatgttggtgtgctgcacccattaactcgtcatttaaccttaggtatatctcctaatgctatccctccccctcccccaaccccacaacaggccccggtgggtgatgttccccttcctgtgtccatgtgttctcactgttcaattcccacctatgagtgagaacatgaggtgcttggttttttgtccttgcgatagtttgctgagaatgatggtttccagcttcatccatgtccatcttttctatacatagtctcattctcaaatccttttcaaaggaggtgagggagctatatctattcctgtccacctaaataatggtttcagagacggtattaactaccatatctcccagtgctcctctccacttcccatcctccctagagatcaggaccaggaccctgactcattctgagaaatggactatgagcaaaggggttgagatgtcacttctgggcaggtcagagctgatgtgcctcctccacattgctctgcttttctgccatgctgatcatggaggccatgcgctccagaggatgtggtggccagatgcaggaggactgcctgacccgtatcagatctcacattgtgacatcttcttgtggtaagccactgagattcccagggtttttctgttgtagcaactaattatcaattatcctggtagtaatacggtcatcataaccacagctaccaccacttgtttaacgttgaccccgtaccaagcactatgctaagcactccacatctgccaagtccttacattttagtcgcttacctgcacttatcagatgtgtggtttcaagagggctctgggtttgttaataacatatgagggaaagactctctctgggaggcaggattctcagccctaagcgactctactaccagagataacacctgcagaggcacaagcctgacaaatgcctgttcccatgagtgtgaacacgatgtcactaagtagaatgcagacttacttcatcaatgagcaagaaacacagcgttcaaagaggaaaaagaaattgacaggtgggatccttccctctccccactggcaaatgcaaagcgccaagatgaagctcctgctgcatgactctgaatttgaagaaagtgcttcctgatatctgatttcctgtaaaaatgaatcccttccagttattccctgttggcttcctgttgttcttaggaatgacatcctgggctcccacttgaagttcacaggcaggggtaggttttggtggaggggatgtgtgaaccaagtattaatgcatgagtaggaatttgccagccagagaagggaaaacagaacattccagaataaaagaacagcaggcaaagacatgggattatcagaagagaggagttagcattttaaaaaatgatcattaaaagctcagtgtagctgaaacacaaagtgtgtgacagagatcaggctggagacttaggtggtgagggaggccctcctggaccagcagagtctgggacctcccaggtgagtgggtctaatcctgcattcaggtaggagcccactcacctgcagatataagctgaatattccagcctaacttttcttatgtaataaaggtgatattttctttcccatctgctcattcttttttcttatttcttaattggtttgaaattttggcaggaaagaggggatgttacttattgtgtctgatatgggtttggctgtgtcccaatccaaatgtcatcttgaattatagatcccataattcccatgtgttgtggaagagacctggtgggagataattgaatcacagggggggggcggtttcccccatactgttctcgtgatagtaaataagtctcatgagatctgatgattttagaaggggtttcccctttcacttggctctcattctctctcttgtctgccaccatgtaagatgtgccttttgccttccgccatgattgtgaggcctccccagccacatggaactgtgagtccattaaacccccccttttttttttttttataaattacccagtctcgggtatgtctttatcagcagtgtgaaaatgaagtaatacagtgtcccttcaaagtccccagcagtggctactaccttcaactccatttcacagatgaggaaactgaggctcagagcactgaagttactttaatctggttgtatccattactgatatctacctggtccacacaggtgtggctgtaccagctgttaaaatgttcagatattgtgtgttggttgagaattagctgcttccctgatcccccacctccacctctaccccatgatccaaaaaccaaaaggataacatcaggcacagcaggggcttttttactgtgctccaaagctgtaattgactagttagttcctgaaccatgtcatttgttaaatattttgagtattacccctagttacatggctgatggatgccaacattagtttgagcccatgtgtagctggctctaatgccagtgctcttttcatgctatgagccacgtcaagcccagaacaagtgaagaatagtcctgctgcaccccctacacatgtcggaccactatgaagtctcgggttcaactttggaagacatacattgagaaagatgctaaatccctggaattgtccagaggagagtgacagaggtaaagaatgacttgaaaccacatcatataaggaaatgctggcagcattagggatgttaacctggtgaagagaagattcaggggacctgagaactgtcttctaatatttgaagggcaggtgtgtgaagagggttagactcaaaatggaacttgcaccaacaggtgtaattagcagccaatttggtgcttgttcattcactagataaatactttctggacaactgttctgtgcaggtgctaaactgggcccgagaggtgcaatgtggaacatgaataaggagctgccactcactggggagatgggcacatcaacagatgattacagcacaaaaatgagaggtgctggagaagcttggggaatggaaccctgaaaccctttgagggaactggtcacgctcttggagaataagagttttgatcagaatcttagagaatgtgtaggagattgccaatcagagaagggaagagagatggaacagcatatgcaaaatagcagagttgtaaaaggatgcacaacatttaaaaacaggtgagacgcagagtgtggctggaataccagacttgggggcagaaatgcagctggaaattgcagatgtcttaggagtttggacataaccctggggtcaatgaggaaagactgaaagttaactaacagggaaatgatctgattgggatgcttttgcaggctcagatttgagttcagttcaagaagaccttttcttgaattacagccattcagagatgaggtgggctgcccaggaggtggtgagctctctgccactggaggcattcgagaagagatgggagggctattttgaagggatgttagccaacagatcccagtatccaaagaaggatcaaatgaggtgatcttgatggtccattccaaccttgggcttctctgagaactgaaaatcgcagtcccgtgggggctgcaggcaatggggacaaaagaaggtttgaggcacagtagggtgggcactgtagataaatgttaccatttaggctttggcttaattttatttccagatggctgagaaaagggagacactggatcagggcatgaggaacaggttccaaatgtcttcccccaaaacactgggagatgcagagttgacaataataggctggtacttacagacatgagcactgttcttagcattttacattggtcaactcatttaatccacatgcagccacacacagtaatattattatctttattttacagacgagggaactgaggcacacagaggtaagcaacttgcctaaggtgccaaagctgggattcagacccaagcattctggctctagagcccaattttttttttttttttttttttttttgagacagagtcttgctctgccgcccagtctggagtgcagtggcgtgatctcagctcactgcaagctctgcctcctgggttcacaccattctcctgcctcagcctcctgagtagctgggactacaggcgcctgccaccacgtccggctaattttttgtatttttagtagagacggggtttcactgtgttagtcaggatggtctcgatctcctgacctcgtgatccgcctgcctcggcctcccaaagtgctgggattacatgcgtgagccatcgtgcttgccctctaaagcccaattcttaaacacgataccataccaatctgtgcctttcctcataggacaagctctaagaattagtagaaacctttgtcaatagcgaaattagtgggagacagtgttcactttatagatcagtttctcatagggtctctttaactagtatcttcccaaacatctattattaatcagattacagtcaaatgtcccaagccaaagggttccaaactcttcctcttaactaagataaggcaaagaggaaattagttatttgacccaagtatttacctttctagtttaacactttccatttttccagacaggaagttaaagcaccaagccctggccgggcgcggtggctcacacctgtaatcccagcactttgggagcccgaggcaggcggatcacgaggtcaggagatcgagaccatcctggctaacacggtaaaaccccacctctactaaaaaaatacaaaaaaattagccgggcatggtggcgggcgcctgtagtcccagctactcaggaggctgaggcaggagaatggcctgaacccgggaagcggagctggcagtgagccaagatcgcaccactgcactccagcctgagtgacagagtccatctcaaagtaaataaataaataaataaataagtaaataaatacaaaataaagcaccaagcccttagtcacacagcccagaatgactcctaggtctcagcttggattcttataggatctcatggaaatctctggaaaagaagagaacaggacagaagacctggctcaacacagagcttcaatactcgctggcttggcagtggaggcaaggaaaagaatggttgggagaggatgggaaatgaagggaggatcttacaccaaggacactgctgtttgaatacctagtctctgccaggcacagacatgttctttctcactctatagacaaggaaacagaggatcagagtagaaaagcaattcagccaaggtcacccagtgaggaagcacatgagctgggatgtgaatttagctctgcctgagtccaaagcccatattctttccattttatcctacagccttcccatttcacctccttggccttgttttctcctcagcaaccagaagtccacgttattaacaactttccccattgtgcatagtatgctttaaaatattccgtcttatcacgccattaatagcaacactagcaacaaaaacagctcacacgaatagctataaggtccctggaactgttctaagccttttataagtattagctcattaaatcctcactaagaccctatcacgtatgatgccctccgtttatagggaagaaatcagagaaagtaagtaacttacccaaagtaacatggtgaattgtccattcaataatagtgaataataacaaatcaatgaaaaccttgaagtaattgaagactgctccaattaccaatcaagtgatcaatatgagataatcagcatttttttaacactagctatttcagttaccccctgagtgagtataaatgtatgattcatatgtggctttgggaaatctaggaagttgccagtggatgcctaagccctggtggggaagggggcggccttgtgagatgtcacagtcatctgatgcctagtatcccagctccaattctgaacattcaatgtctcaccagcagaacggaaataaaggaacaacccttggctggcttctgcagacaattctgggccatcctggtgccccgagccagctagtggcctagaatcccttctaaccaggggcagtggacacagaggaaggaaagaaaggttggagacagaggagagggagggagcattagggagagagagaggtggaggagacgctgaaggctgagacaaccgtccatgctgcctgctgcccacctgcttgggaagaggtaagtcttgggaagaggtaagttctagcaatttcaccagccacttgcccacctgagctagatagggtgggtggtcagtatccttggggctcaggtgacagttgtctttagctgcctctccccttggactctaatttgcacagatgagcttgaaggcccgcctgggaggtcaacatctcctccctctcctgttccttccctcctggagactgggcggcctgaggcaactgcagaaggcaatgagttggtcttcctggggtccaagcctccttttgggggcctctttttcatcttggtggcaactgtttccctccagaggctacaggtgtcatggaaaacccagctctggactcaaacagacctaggtttgaatcctgactcatcactactacctgcgtgatcttgagcaaatgaattttcagagagaataagaggtaccacaccagccgggtggagggattattcatgagatgatgacccctttcgtgcccaggccaccccttgctctcactcccccttctcagtgcaaacctactgtagagagtggcttgtacatcagtgccctcaggagttaagagcagatgctaccttctctgcattttgatagagaacaaacaactctatgaacgtgtttaccagaagtttaagcaaatctctttccctcgttggggactcatttttcccttcaaaatgtggaaatggatggcagacctagatgattccagaaattattctgagtctgagagactgggcactcccaggagcccagtccaagctaaattgtaatagacaaatcaccaacgggaagcgatctatgagagccgttccctgttattccagctctactcattaatgcctgcttcttacctaacagtatgctgggtatcgagtgagctaacaggccgtgtaataatagctaaatgtcaccattcctgagggcctagtgtgctaagaaattcatctatttaatcttcagaacccaatcctctccttatcttcatttcacaggttaataagtaagagacggtcaaatgcaaatttgggtctagtggaccctcaagtccatgctttcacccaacatgctactgtgagtgtctctctcttaccgcaggactctgtcaacccggagaagcagctcactgtgtcggtaaggagacaggatgttgggcagaaaccccgctgagaactaacaccaccaccaccaccaccaagggcaagctcaggaacaatgatggtgtgggcgattgcccacgcagcagggtggtctgacaagagggcagacccaggcagaaaagacacacagagaccggcagggagcagagagaggagagtgggagagccggggagtcgggcttgtccaggaagactttctggaaggtgaaggaaggaaagcaatgtttacggggcacccagcactctgtgctaggcatttcagagaagtgatttcatttatcaaaatgttaggatggctctgtgagggaagaaacggcactcttctgacgggttaggaatgatgggctgggaaagggaatcagtggtgcagaagttcactgctaggaaccaggaggagccaggatttgaatccagccagcagggatgagggtctctctctctctaaactctgcgctcccagcacccagcttcccatccagagcagatggagagcctggacttttgctttcactgatattggctcctgttccccatgcacaccctcagctcccccagcttaagtgggttgtgaagtcaccgcctgtctttcctgccagctgcttcagcctcaggccgcacatctggagggtgggactccacccgtcttcaaaccagatgttcgggggtggagggggtggatggcggactgtcactgaccaatgcctcctgtttgtctcttctctggtaatcctctttcctttcttgtccagggaatgtgcagctttgggcaggggccttgtcagattccctcagtagcttccccctcccactgctccgggaactggtgactggaaactcggagaggtctgcaagacgcagccactgcacggccctgggttagtcacagcaaaggtatttggcacctccaagtacctgcagagccttcctgggaggggaaggggaagagaggagacagaggcagagagagaaacggacacgtacacccagatagagagcagagaaaaacacagaggtggggagagaataagaggcagaagggagaaaaaagcaatatggagaaagaaacgcagacaggaatagaggcagaaagccaggaagagagcgaggaggacagaggcaggatcaaaaggcaggaaagagaagacgctccagccagcgtggtgccgaccagtcattcctgctgcttagaaggcaattttataaaagaaaagaggagaggacaaggaaacagttactcctaagtaatgaaattgactttccagtttgaagttggatgttgactcagggctctttgacttttgaaatcaatttttcagtttcatagtcacctcttaagaattgttgtccaaactcagtttccttatctgtaaaacaagttaagtgacggtcagttcacagagttgctatgaggactgagcgggttgcaggagcccacatagactgtgagatgctgcacaaggatcaggtccacggttgcagcctaaggggcagaagaaaaggagctccaagaatccccctttgggttgacttttatgaccagctggtgccctttcccagacagttggtctgattggaaatggatccccaagaagaaaacattaatcttcacataaaagatgcccaatattttcagtagatccagctgggtaaccatgagaaagtcacttcagctctctgggtctctttgaaatgacagctggactaaataatattttaaagctacctttagcttaaagcgtggacaaacccatgaccacagggatgaggaggtgctagtgtggtgaaggcttcaccatgggatgaaggctttcatatttggatgtgactgggtgagggttgggctcttctcagatgtcccttcctccaggaagccttctctgattcttccagcacaggtacagtgtcttcctctgggcccccagtccagtgctaccctaacatgtgttatggttgtctgtgagatgactgtttcctaactggaccatgagctcctgagggcagagactaccttgttcagccccaggtgcccagggcccagggcctggcatttgcaggtggtcagtggatgcttgtggacttgaatgggactgaattgccagcccacattctttcccattaagccagacattttcaaggaggaagggctggggccaggcttagccgccggaggctttggaagcaacctttagacaatttgtgctgtgctccaaatgctttctgggagccaactgagattccagggcagctgagagccaaaaagggcgggaggtagactccctggctggagggagcctgggtggggtgggggacaagaaaggggaactacctcaacacaatggctagcatttctcctgcattttctactttacataatatttccacaacaccattttgtttgagcctcatgcgaatcccagggctaagtagagcagttcaatagcacgatttttctttttcagacaagtcggacaagactgagagaggcgaagtgacttgccagaagtcacacagccagatttgaagttgaatcttgaatcctcagatttcaggtccagtgttcttccaagaccaaaaacaaaacaaaacaaaacaaatcaaaacaaaaaaattgggaggtgatgtccatgggtctgtgttattttcccattcattggtagcttaatgaattgttctgtctttctcatcccatcaatatttaaaaattaccacaattggggctgctattgatgggacaccggtaaagtgctttgttgtaagtcctttatcaacattattatatttaatctgatcgatgaccctataagacaagttctattactaaccctattttacagatgaggaaagtgaggctcagaaggaataaggaaccaactaaaaatcataaagccaatgagtagcctagatttgaacccaagatgtgagactccagagtctgagctctgaaccacccaccatgctgctaagatttaattctttacaccaaagcaataaccacgcagtgagtgggttccagcgcccagcgatgagctcatgcaccagtgtcagtggagaggcatgttgttggccttgtgtctccagacttggagactgacctgtcctgggcctgccctgtccactcatgcctgattcttgcctgggcttggtcagtacaggtacactggccactatctgcaaagctggagcagcataaaactaatgatcccaagggtgaagcaaacagaagccttgctcttggcagcctgagctcatcaccaagagtccaccagcctggacatggcctcgtgtcctggcattgtggagcagtgaaaagagcttggtgttggggtcaaacaaagccaggttccaatccagctccgaaccttagacgctggatgaccttgggaaaggtagataatctcaccaaacctcagttttcccacttgtaacaagggcctaatatgagtctcataatataagaatgaactagaacaacctacctgaggtatcttaatgcagtggccaacagatagtagatacttataattcttcattcaagagagggtggcccaggagaaagagcatgggatttggggtcagacagatctggtttcaaatgctggttctgccagctgtaagttgtataactttgtacagacagcaacctctctgagcttcaggttcctcatcaataaaacaaggttgacaacaactgccttagagaaaatggcaaaaccaagaaagggtgtcgggggcaagggtgtgatcagagttcagtgaagagtatcttacatcaacagtaaaaagttgatcttcccctcttccttttcttggagtggagcatgggagaattcattcattatttcatgcatccagccaaaatttagaaacattatctgccatgtagataaataatgatgtaacttggaaggtggttagactgagctgtttgctaagtgcccttgccaatctggggacagcgcagttgtggggagatggactcaggtcttatcctcgaccagaacgaaggtagcccctagaaggtagaaggcatggggccaactacgatggaacattagaagcccctggtctctgccccaggtatccccagtaacacctgtggcctctgtctccctcggccttcctgagccaacccatggcacggttctggcttagctagtgactaaaactccattctggtgatacttttgggttctgtttcctgggtttccctctggggcttattgaaactctgggacattttgcccccgctcccaattccctctctgttaatagctgaccctgcttggctgtgttaatccacttgggtagctgtaacacattaccaaagactgaggcactcataaacacagtttctcacacttttacaggctaggaagtccaatattaaggtgttggcaaatttggtgtccagggagggtccacttttcggttcatagacgactgtctgctcactgtgtcctcgaatgccaaaagcatcaggggatctttctggggtcttttttacaaaggcattaatcccattcatgagggctctgccttcatgacctaatcacctcccaaagccccccccccaccccaaaatacacacacaaatccattacctcaaaggttaagtttcaacatatagccgtgctcagtggctcacacctgtaatcccagcactttgggaggccaaggcgggtgaatcgtgaggtcaggagttcaagaccagcctggccaagatggtgaaaccccgtctctactaaaaactacaaaaattagccgggcacgatgatgggtgcctgtaatacaaactactcgggaggctgaggcaggagaattgcttgaacctgggtggcaggggttgcagtgagccaagatcgcaccactgcactccagcctgggtgacagaatgagacttcatctcaacaacaacaacaacaacaaaaattcaacatatacattttgtaggggggacacaaacattcagtctacggcattagtcttctctgaagatccctgctttgcagtgctgttggtctaaactctaacccagccctctctggcaatgataaatattcatttggtagagactgaactgtggttggaaggaagagtgaggagaatagttccaggtcaaacttagcatgccaagctcctctggatggtaatgagtcagggctagataggggtctgtttgaatgagagtctgatgccttccctaagtgcagtaggagtcagtgcctactagtagagttcaaggccatgagccaggattgaaggagggtagacgtagggtcaatatcaagagtggtatcttttacaaattcattctgtaagcacctactaagtgccaggtcctgttctaggtgctagagacacggtggtgaataagatcgatgtggttggagacaggcaacagacacataaatacatcactatattgtatgttagctgggagatgagctacagagaaaaataaatcaagagaaggggacagagaacgccatgggttagaatgggttcaagtttcaacagtgcagccagggaagccctctatgagaaagcagtatctgagtagaaatctgaactaggtgtgggacggaatcatatgaacatctgggagaagattgtttcagggcaagggcaagggcaatggcctcgaacttggagcacacctgttgtgttcagacgacagccagggcttcatatctattagagctcttattgcctaaaccccttctgcatcatggggatgaggtctgagaaataacggtggtgtacaggtggcagcgggtgtagatcatgtagcaccttgtcagacatggcaatgacttagactctttgtgggatggggccactggatggggtggagtgctagaagggtgacctacactttgcagtgtcatcctgctctgctgagaatatactgaaacagggcaagggcagaaaccagaaagccagctagaaggtggctgcatcgaagggtgagagatggttggattctggagggatctggaccttgggattacagggtttgttaacggatttgattgggtgtgagggtgggtggtgagagaaggggcaagcaaggaagactccaaggtttggggtctaaggcacagttgcctaaggtaacttggatgggaaaggctgaggaaggcacaggttttggggtggggagaagatcaggagttcagttctggaactgtgagggtgaaggcccatcagacatccaggggagacacctcatagcagtctctgatatgtgaatctggagctgcgggttttcaaaccatgacaccaggttagagcaacaaaggaatgaaggtgtgtgtgcaggcagggagaaaaagaggaccaggagccctgagcccagcccccagcccccagcccccagccggtgttgaagctgaagggtaacccagtgacgccaggagggacgctggtgagtgtgtcatcctggagccaaagtggagggggtgtttcaaggaggagcaatggaccagctgtaggtcaaattaggtaagatggagcagtgacctttagaggtcactgaccttagcaggcgcaattgcagtgcagtggtaaatggcagcagggccactcagaagtggcctctgctctggccctgagaagttaactcagaattccaggggaaaggcgaaagtgctttttaaagaagaggggtggggtagggaaacaaggcatgcccctccaatgttcccctgggatctggggagtccaggtgcgggtggtcatgggagagatcgggggacagctctcttgggcaaggtgtgtctctgactcagccattgtcagtcgcgtacaggcctctgtgggtgcccggcagaactggcctataggcagtttctggtggtgaccttggcagagggtgttgacagcagtgggatatcaccaccttcagtcagagttgcagaatcagaacaggaggaataatgccacttgtttgccaagaggacaaattctgggagaccttgtgacaggccctctcagagccgttgaggaaaggcttgcaggggctaaaatgcttaaacagtggaagcagagccaaagaaatcttgttttatgatggccatagtgatggtttacactcagactggtgaggccagagctaaaataataggaagcatttagtgagcacttactatgtgtcagctgggcactctctaagtgctttatgcatgttctgatgttttaaagcataaatgatccttctctgaggaaaaacactgcatactacatattctctaggttgttcgtttattatctgccacttcctcattagatgataacctcttgagggcaagatttgttgattggtgcatccccaactcctagaacagtgcctgaaatatagtagatgcttaataaatacttgctgagtgagtacatgactacgagtcccctaggcattgaacttgatgagccctcactgtgaatccttactgagggtaaagctgggaacagcagccatcctttattaagcaccaactgtgtgcaaagtgctaagcctgtgccctctaaatataggtcgatatcctgcaaccactgagagctgtgtttctggtcactgactcagtttagaacattcgtctccatccttctcaccaaacatttgctctcctcactaccaaaatcttgctcatttatgagctgtcctcctccacggagccacctctgatagagctggcctgcctctggccccagcctcccttcagccccctcagcacaaggttgtgggtctgagctgcgattaaattaaaatgactcattaaatcacaaaaactataatacaatgactgcttctgctactccttctacgactcaccgcatttgttctgagcacttgccgcgtgccggggctctgctgtccctgtccaggcctcatcttgtttcaccctcccaccaccccagaagggcatcctatttcttttattttgcagacaagcaagcagcccctgctctcggccagtcacctaacctccttctgggggtcctggctccttgtcgatctctgatcgacaggagatcagagagttcctgaagcagagatggtggggcaaggctgaagtgcagagtggtgaatgccatgttttaccatggggagcatgcatggggggccggcttctctggcggaagtgtgtgggaagcagagaaatggagcgggggtgagtggaagccccagaatgcagcaaagggaaaaccgagcactctggggaacagctccagcctcccccagaaccactgaaaccaccagaagggtcaggggttggtcccaaacaacatggacttcctcctggcagtgagccagctggagaacctcagcagaggccaagaagagcccctcggggcccctgaggaagatgtatatatgggggttccatcagcagcactgcccctctccatctctgcctgagctctcctttccccccagaaaaccaaacagtagagcctgctggggtcaaagggtcaggttgtatgaaaggtcaaaggtcacgggtcctgtgggcctgcagatacagatcccatgactccaagtcaggccggtgggagctccttcctagtcccagggaacaaccccaggggcccacacttggccacctccagaaattcccaactcctgactcaggctgtctctagaggggctgcagctgcctccagaagaccctgactgccccatgacgatgacgcatagggagcttcctggggaacggctggctccacctcaggaagggcccaggcccaacagactccccagcaggggcctacacccagccaccgctgggcttcttagcccaccagagaccttcactggctccccacgtttcacaggaaaagtccctatttctggcttccgaggtttccaccaccctttcattctcgtctatggaatctttaagaagccccacactccaaaggaatctttattcttgggtgttgatttatcccatacacttaacgcccattgtgcctttcatcaatccctcctttggccaacacagaccaaggggtcaccccaggccaggccctccaggccttgtcctaacagaagccaatgagagagccaggggggtcaccccaggccaggccctccaggccttgtcctaacagaagccaatgagagagccaggggcctgctctcacggagctcacgtgcttgtgtggaattctcatccccattttccatatgagaaattgaggctctgagaatacgtaggcagcacagcagtggtctgcacacaggcttgtctgactccagaactcttcttttaatccccatcctttctcataaccactcgaagtccccggaccatggtggtggtccacacctctgggcctttggacgactactccattgacttggaatgtgctcctcatctcttctccagctgattccctttcctccctccctcccttcctttttttctttttgacacagagtctcactctgtcgcccaggccagagtgcagtggcgcgatcttggttcactgcaacctctgcctcccgggttcaagcgattctcctgtctcagcctctcaagtagctgggattacaggcacctgcaaccacgcctggctactttttgtatttttagtagagacggggtttcaccatgtttgccaggctggtctcaaactcctgacctcaggtgatctgcccgccttggcctcccaaagtgctcacattacagacatgagccactgcacctggcctctttcttttaaaaaaaaggactttgcactttggtcatcctcccagtactggactactgaacactgcccaagcaaccagaccatcctctcctgctgccgcagacctgatatgtgaagagttggtcctgagcaaggcaaacaaagttctgcagaatctcgccttgtcttagctcctccacccggctcccccttcccctcactctgatctgcactgtaaattccagcaagtcctcagacgttccctgagcataccatacagtcctacaccttgatgcctttgctccttcggcacttgctgaaagggaaggtgagcgtctccatgtaacattggccaaacccttgtccaaagtctccagattgagaaatcactttcctgtgcttttcctggtgggtggagccttgttcagggccagagaggcctccagaaattctccctatcttagtcactcttctctccatgggccccacagctggcccagagaaggaggtggaaactccctggataggaagggacttctaacctctgctccccctgcaaggacaatgtgagactcagcacaactccaagtccttccctcccaagtctggcactgggactgagggactagagagcagagcagaggcgcagaggctgggaactggtctggggaaggttggaggaaggaaactaacatcgaacatttactgagaactatggagttccagcactttttgcaaaggtcatcttgttaaatcccatcaccccaatgaggtaggactatgataattcccattttatctgggctaaaacgaaggctcagagaaatgaaattactggttcaagatggcatctccaggttcaaaacagtgaatgctcttgtcactttcacccgctgccttcagacccaccacactgactgttccagaggggaaagcaatcttgagagcccttgaaagctaatccttgaagcattcaaacgttacatggcaagatcacctaattctggtccaaggggctcccatgatgatggagaaacaaagaccagagaagttttgcctggttccaacatctggaggtggcagaaccatgattccaactcagatcttttgactccgagctcagcgttctttccattagtttatctactctaaagacaaagagctttcttgcccaggaaatcatgccccaagcctactgcaaatcccataagcagagcttccactcttctgtcctccaaggatggaggaggaagaacactttgtcattctgttgtgggcaaccttcatctaccatggtggccccagccccaacttctcacacaccaatgcccttctatgacaaataccacttaatgccccttgtactatgttgaaacaaaattcatagtgaacctacgtacacaattttttttaaaaaagttaaaacgtggcccatatgcaccatggaatactatacagccataaaaaagaatgagtccacgtcctttacagggacatggatgaagctggaaaccatcattctcagcaaactaacacaggaacagaaaaacaaacgccgcatgtttttactcgtaagtgggagttgaacaatgagaatgcatggacacagggagaggaacatcacacaccggggcctgtgggggttggggggcttggggagggatagcattaggagaaatacctaatgtagatgacaggttgatgggtgcagcaaaccaccatggcacgtgtatacctgtgtaacaaacctgcacattctgcacatgtatcccagaacttaaagttcaattaaaaaaaaaaagttaactggagtcccctaactgtaacataaagcaaaaatcaaacagaaataatttatagaggcatagcattaggagatatacctaatgttaaatgacgagttaatgggtgcagcacaccaacatggcacatgtatacacatgtaacaaacctgcacgttgtgcacatgtactctaaaacttaaagtataataaaaaataataatttataatgaaaatggacagtctgatgcttgcacctatgcatagaattgccatgcattttacaactatacatgccgactgatatagtttggatgtcccctccaaatctcacgttgagatgtaatcccagtgttagaggtgaggcctggttgaaggggtttgggtcatgggagtggatccctcatggtttggtgctgtcctcagtatagtaagtgaattctctctcgtgagatctggttgttcaaaagtgtgtggcacctcccctgactcctagccacctctctcaccatgtgactttgccttccaccatgagtagaagctccctgaagccctcaccagaaactgagcaggtgtcggggccagtcctgtacaacctgcagaaccatgagccagtcaatctcttttcttggtaaattatccagttttgggtatttctttatagcaatgaaagaaaagcctaacacaccaactgaaatgtttcattaacaactcaaatgccagaagtaggattgccattgtcatcagtgacttgattttttgaaatgattaacaactgtcggaaatgtttcaaataaagcaaagtataattgtcccttaattgacacagtggttgcacttttttttgagggggggtggtttggaggaaaagcaaatattgaaagtgcttcctgccactcatcatcacccctagtgatccactagcatgatttttgcttttgcttcctgttctcacaccattacattctgctggcatataggtcttagttccagagggaggaacactgccaccaggagacacaacaatgattctattaaactggagttaagattgccatctggacactttgggctcctcctaccttttttttttttttttttttgaggtggagttttgctcttcttgcccaggctggagtgcaatggcgcaatctcggctcaccacaatttccgcctcctgggttcaagcgattctcctgcctcagcatcctgagtggctgggattacagcggtgcgccaccacgcccagctaattttgtatttttagcagagacggggtttttccatgttggtcaggctggtctctaactcctgacctcaggtgatccgccagccttggcctcccaaagtgctgggattacaggcgtgaaccaccgtgcccggcctgggctcctcctacctttaagtccacaagctaagaagggagttacagtggtggctgggttgatcgaccccgactatcaagatgaaatcagtctactactccataaaggaggcaaggaagagtatgtgtggaatacaggagatccattaggacatctcttagtattaccatgccctgtgattaaggtcaatgggaaactacaacagcccaatccaggcaggactacaagtgacccagaccccctcaggaatgaaggtttgggtcactccaccaggaaaaaaaccacgacctgctgagatgcttgctgaaggcaaagggaatacaaaatgcgtagtaaaagaaggcaatatcaataccagctatgaccatgtgaccagctgcagaaacgaggactgtaactgtcatgagtatttcctccttctttggttaaaaaacatgtttgtgcatttatacacttgtactaagaaaatattttcattttatttccttttcctttatcatgccacataagatttattgacttcatatcagcatttaaatattgttaactttatgtaatagtatttaggttggggattggtttgtttccggttgtaccaaggatagttgtattatgttaggcataattatgaccttattattgtctttatttgaagattatgtatgatctgaggagatgtgtatgggttcaagttaacaaggggtggacttgtgatggttaatactaagtgtcaacttgattgaaggatgcaaaatattgatcctgcgtgtgtctgtgagggtgttgccaaaggagattaacatttgagtcactgggctggggaagacagacccacccttaatctggtgggcacaatctaatcatctgccagtgaatataaagcaggcagaaaaatgtgaaaagacaagactggcctagcctcccagcctacatctttctcccgtgctggatgcttcctgccctcaaacgtcggactctaagttcttcagttttgagcctcagactggctctccttgctcctcaagcttgcagacagcccctattgtgggaccttgtgattgtgtaagttaatacttactaaactcatatatatatatatatatatgtcttattagttctgtccctcttgggaaccctgactaacacactgcctaaatactttgtgtttgaatttaatatggaattaggttctaggctcagataattataaatgacttttcacctatatggtgtctggtaggaccaaatccaacagtcctgtgggtagcaggacagctgttggctgtgcagagtatcctgtatgcattcccagtccccctgactatctgcccatagtgcccattgcttgtgatgataaccaaaagtcttcccacaagtttccaaactgcatttcaagggagggtcctgtccccatggaggaccattaaccacatcattaagatttactcataagattatatcccaacctctcaatatctctctaagttctttaagccctgtattcagttgtggtcgccagatggaagagacagaagcaagaggaggtggaaggagccccagaattagacagggaatccagcttgcctttccactgctgcattcccaggcctagccagcacacatgaggtgttcaacaaatattcatgacatgaaattattagccgtgtaggcttggggaaattatttaatcttccggaactgtcaattccctcttggtaaatggatggtcacaccatggggctcttgaaaggaccaaatatgagaaagcccaggatatgtacaaggggctcaacgactattagttgaccatgaaaatcgtggtcctgctaccatcaggctgggatgaaattctcaatcatggcacagctaacagaagagtgttttcaaatcagcctgtgactagactacttgacattttggaatgtaatttcttccaaccttgagatctggcagttctgagacccttgtcttgacagagctggtggtgaggagaaatgtccccatccaccctcgacctgcctgattcctacattcctaccacccccagcactcacccacccccagccagcacccacggcacccccagccagcacccacgcaccaccagccagcacccacccaccatcagccagcacccacccacccccagccagcacccacccagccccagtcagcacccacggcacccccagccagcacccacgcaccaccagccagcacccacccaccatcagccagcacccacccaccaccagccagtacccacccacccccagccagcacccaccaaccagcagccagtacccacccaccagcagccagtacccacgcacccgcagccagcacccacccaccagcagccagcacccacccacccccagccagtacccacccacccccagccagcacccacccaccagcagccagtacccacccacccccagccagcacccacccaccagcagccagtacccacccaccaccagccagcacccacgtgcccccagccagcgcccacccaccagcagccagcacccatgcatccgcagccagcacccactcaccccccagccagcacccacgtaccccccagccagcacccacccgcccccagccaacagccacgcaccaacagccagcacccatgcaggcctgcggcccttccttgattgagtctaaaggaaggtctccctccattctgctcctgccctgcccttcggttgaaggagaggagaagcaaacaattactgagcacctcctgcatgcttggagctttattcttccccaagttatgctgctaaatctcgttctcgaagtgggatgaaggggagtgacatcccacacatgaggaaacggggctcagagatggtaagtaatgtcatgtgcccagggtctcagagtgggcatgaggtggacattccttttggagtggtcttcccttccaccacagtcaggggaggttgacagaaggcacatgcagggccccccgtgggcagagctcacatcacaccagcctcccaccgtctaccctagcccacacccacagtgcccaggcttctgaaattcaccaggctctgagggtggggctcctctgtccttccccactggttcagaggggcggtgtaaagacagacagggagagaagatgaggaaaatgtcagcaggcctcaaatgccaggggtactgggagtgagttggaaccagagcaatggatagatttttagcaggaccaaagagaaactttgagtatatttgagagtgagatgctttagaagactatgatgggccaggacacttcacactgcccaggcagctggtccagggtcaaggaaacactggcgtcatagatattgtaaggggttcctgtcttacaatgttcctctcaacctcccatttccagtctgttccctctagcagggggagctcccggggtacacggtgtcccagccagctcttcaatctagaggacagcagctgctgccagcctctgagggctgggaggtggagagttgaagcccactgggtcatctgctggtcaaatgctgcagggggcaatgcatcttcagttctagtgttaaccttgctgcaaaggtgctgtgtgacccagtgccggttactgttgctttcctggcctcagtttccatattgccaagttgaggggattggactagttgattaccaaaagctctctttcctttggtttttatgaggagcaggagcccagggaagaaatgggacatgagagagaggcaaggggtggccgatagaagccatgcgcgtgagtcacgagaaggggtgtgagatcccaaaaggaagctgagcaaatttgcagaatgtcaacaccccagggcaggtcactcctagcccttcactgaccctggaagggagtggggggacaacagcaaggtcaggcttcccagaggccatgggatttagccagcttgctcctgagggctggcagcccagttttgagcacctcttgaaggcagtggggcaggtgcttctggtgggggtgcctctgaaaccccagaatgcagtatagtcccagagaggtcaggtcctgcagatttctttggtgataacagctgctttgttttgcggggaggccacaaaattccttttaaagcaagatttccttcctccatttatttatttacttttcacccagtgattcagcgaaacaacctcaaaaccagtctccaatgggaggcaggaagaaccaaaccctcaaacattagtgtctctgtgaggttttgcctggtggaattttccttaaaataactgcacccggagattgtcggatacgggatggggaaggggaagacctgaaaacggggtcctgcggggcttgtgaatgactcagatgctggagtgaggagtctcaggagtctgccctgagtgccacctgtccttagcgagggcttgggtgggtgatggcatcggttttctcatttcacagactccagagggtgccatcttcctgaagacagaacgagccagtagtttgaaccctaagtgcaagagaagggactcaaggcagcacgtttatagcagtggggtaggattttagcgccatcttgctccctgtccatacatccttcctcagggttaaagcagtgggctgggactggcatcctcttgctcctgtccatgcgtccttccccagggttatagcagtgggctgggactggcaccctcttctccccgtccatacatccttcctcagggttatagcggtgggctgggactggcaccctcttgctccctgtccatacgtctttcccctaattcctaatgcaatggctttagtttctttaactcagtgggaacaacaaacaaacagaaaatgtctttctctttgttataacacatctgaattggaaaaggaccaacaagataaaaggttgtggtggaaatggtgccagattagaaattaattcaggatacctgggatctatttcagctttggtgtattaagccatgagaccttggggaggtcacttcctaaagggcataaagatggccagggtcgcgaaacccagtgtctgcaaccaggaagtcaggtgatatagaagaacaggtctgctgatggacagagcgaggtggggcgggcgcccttgcatgaaagtcacatggacttgggggcacgccctggttcccacttattgataggatgatctggggcaagtcaactccttctttctgagcctcagcttccccatttgtaaggtaaggaaaatagtaatcatctcaaagggctgttgagagaatgcacagggaagagcttggtaagccagaaagcatgagtcaaataggagatactttcattactctagacacttaggagcaaggaatattaatcacatagtcctcaaggggaccaaggctaaataacaatagctacaataacaacaattagtatcttattgagtgcttactatgtgccagacactgttttgaatgctttgaatgtatgaactcatttcatcttttttttaaagtgtaacataacatatacacagtaaattagtaaagtgatctattttttgttgttgttgttttttttttgagatggagtctcactctgtcgcccaggctggagtgcagtggcactatctcagctcactgcaagctccgcctcccgggttcacgccattctcctgcctcagcttctcgagtagctgggattacaagcgcctgccaccacgcctggctaattttttttttgcattatttagtagagatggggttttaccatgttagccaggatggtcttgatctcctgacctcatgatccgcctgccttggcctcccaaagtgctgggattacaggcgtgagccaccacgcctggccaagtgctctaatcttaagagtacttcttgatgaagttttacattggtacatatcatatgagctcatttagtcttcaaggcaaccctacactgtttatttccattttacagatgtgaaaaccgaggcagagccaggactcaaatccagacagtctgcatgctggtagccatgcagtactgcccgggcaatccagtatatcgagatggagagtgtctggagtgactgggagtctgacaggtgaagccaatggaggattctgccttagtaggaaactttttttctgtttgtttttgttttgttttttcacttccccaggtgaggaaaggccaggatcccaagctcagggaagaaagtagatgaagctgaaaggaaaggggaaggagatcagggtatggaaaagcaggctgagatagtagggggaggatttgagggaagcggacaattgctgctgatgactgatgcctccaaaatttggtgtagaagccccccccccctttttttttttgagactgagtctcactctgtcgctcaggctggagtgcaatggcgcaatctcggctcactgcaacctctgcctcccggattcaagtgattctcctgcctcagcctcccgactagctgggattacaggcatccaccaccacacccagctaatttttgtatatactttttagtagagacggggtttctccaggttggccaggctggtctcgaactccagacctcaggtgatccacccgcctcggcctcccaaagtgctgagattacaggtgtgagccactgtgcctggcgaagaccccatttttaatcagctttcttaaggaactggcagacagaggatcaagcacagaaacaaaatgtccccgttttctgtaactgctcaccactcccaggctggggcccactcatttccccatggatgtcacccccaacccccaacttcaccctttgtagagaagccggcaaagactgcgttgagaaagcaagtttggaagagaatgacccaacagcctcactgctgcgggtgctggaggaaccagtgggctgctttcggatcacgagaaatggatcagaaacgcagcagaaggcagcctcgtggcctggaagaacactgggctggaaggcaggttctggtcttggctggggttccagtgttggctctggctgtggatttacataatctcccgctaatatcccaaactgggggaagtcacgtgatgtctctgactcttggtgcctccccactatggaattaggggcatttaaaacttactgcaaattctatctcctgactggagaccccaaggcgtgaatctgaactcagccccttcagcaggttgaagttcacatgtgtgaacattgcagtggtggggagcaatggcaagcctctgccatctgtcctcattctgattcatggacattcttcctccctcatagtctctctcctcaaagctcttaagtaggttgtgaaatcatgactgagccgattgacatcatctccttatttgggaggcaggaagttgttccccacccccaccctcttgtccttccagggccccatcctgcgcccccaccccaccccactgtccagtttccggcttcctgagggtctttgagacctcgccgtttgctggcctggatgacaactatttttccctggtttgagagcgagagagtgtgtgagtgtggactgtgtgcaccagagggccagagaggcagtggtgagggtcactcagaacaagccagtcccaagaagttaaaattagctctgggaactggaatgtcggggtcttcaaggagcagcagctgtgaaaagaaagtacaaggcgaggaaagaaaatacaccccatcccacacccgccacaaacctcgctcgcccacttcatctgccctggggtctctgcagcttctcactcctcccgggatatctctggccaagtccttgaggccgatcagtgggaatttccccctgtatgctgtcattttcctctctggtaaccacagaacaaggtggctgaggattcctgataggacaaggtttaattgaaaaacaggaaagtggaggacaactttggggctggggtggtgacgataatgagaaaatgacaggcgagagggtgacagtggaggagggtcgcatagcaaggagggttcgccacaaacggaaactactcctgggagagctggacacgtgagcgttaagagtttgggcatggctggcaggagcgggaggcctgggaaaggctagagatagagaaggggaggaggaaggctgggggactgtgcacccctttgcacagagacaaagattgggtgttcaaaaaaagatcacacaccactgaatgcaggatcttgtgtttttgaatggttggagcttatgtgtcaaactcaggctgtgtggaagaaccttagagaagggccaggagccaatctgagatggagaacttatagagagtaatcccttataagctgggtctgagattccagtcctgtaaacccaggggccctccaagcactaggcttcctcttccagctctttgtccagatgagagaggctggttttcaaggtttttgttgttgttgttcatttgtttggtttttgtttctgctgaaaaaccaggtagcttgcacctctgtggtttggagaactggaggaggtatttggagccatacaattctgcccgacatggggagaaagactggggcgtgggtgagatatagagcctttggaaaaggcacttagggaagggatcaggtggaagtgggtatgtgctgagcaccttttgtgctttccatgaccccagctgtgtatctgcaggctttcttcttctacttctcatgatcacctagaatagaagctccaggaggaagaaacatgtacaattttctttaccaagaaattcccagcactggaaacaatgcctggcacatagtaggccctccacaacaacctgttcaatcagcgtgatacagcagttctgcaaggtcactgctgttgccatcttttatagatgagggacctgatgctcagagaagtggaatcattttctcaatgacccacagtgaatgaaagccaagatttgaatctccgcacccagaaggccatacctattgcatcgcacagccaatcctattcttatgcactgctgtttcacatcatcacctgattttgtcctaggctcctgtccccacctccgtgagcccttctactttcatcatgtcactgagaaccaaatatcttgatgttttcccccaggtacccagtctaggattcccagatatgctccaattcatccttcctctaaataaataaagtatcagtcccttgtacccttcagaataaacctttccagaggtttactttggttgagtgggaatgggtatagacagattccagctgaatgctgcactgactgggcaacactccagattatagaattaaatacgctgatactaaaatacaggacttacgtgtgcaattctgatagacagttgggtatccacagtagaccatttgcgaccccatggtctcaacttccttctttcccctgacagttcttacatctctccctcccttccaaatccaaatcagttataggcctgtgccttccgggatagaatgaatcctattctccaatcatcggaattgactcaatccctactgcgcatcagggatgctacacatgttatttgtgtactttgcacacctgcctactcacaactccttttcctctgcccacaagcacacttggggttttgctttcgtaaataaagtcaagtgttcttctgaccctcaagtagccttctcttcttatttttgtctccacgtttcttaaaggaatattatctggttactgctttcatgtcccctgcaatccagtttctgctcccactactttcctaggattgctccttcaaatgattgctggtgacttcacacacacacatacatgcacacacacactcttatttgcatgatttatcttccctcattttgagatccatgttttgactgaattttcatttgattggaatacatccttaagtaatttcctcagaaagggcctatggatggtatcctagggtgttagagcccctctaatatgaatggcgtcatgactaggtaagggaattctagttcatattcatgtctttcattagtgtaagaacattattccactgtctttgaacttacattgttgcagatgagtaatccggtatcagctttcttttcttttattttctttgtaagtagactgtaatctttctttctctgagaacatttaggattttctctttagagctcagaattgtcaccagattttgtctttgtattgattttatcattcatctttctaggacttggggactcttctctaccaacacttccttctcttgttgatctcactcagcctcatgactttaaatataatctatgtgttaactactcccaaatttacctagactcaattgcttcttcaacatcttcccctggatgtctaacacgcatttctagtttaacatgtcacccctttgatcagacaaattaggtatttctttagttcagagacattttcttctattatatctttaaaagtatcatttctcttccagttactcctctctctccttccaaagttccaattatttgcacatagctctgttgggtctgttccttcatgccccctatctttttgctcatgatttccttttctttgcatttctgctaagtgccctgagataacccagctctggcttccttctgggaaaattcagtggtctttctccttctccttggtctccctgaataactttatactccttttctttcaactgtctcatttctaggctgctggaaagacatgcttcatctacatattcgcccctttctctgccttctttgatggatggctttcctctttttacccctaaaattaggatgtttcccaagtttatgcccaactctcttctctttatatttctttcctgggagacctcacctacattctcaggttcaatcgccacctctttgctgatgattctacctttatcccagacctccttctgagctccaagccatatatgtataatcaactgcttcctggatatctaatgtgtgtatcccatgggcatttcaaatatatgttcaaaacaaatcttgcctttctatgtactataaacactctgttttatcttattttttctcttggttgcaaaaatataccacatctgaacatggctggagaaaactgtgaccatgaactgcaggactcatcccatagtacttcctgagcccattcattctcctactcttccaggcaactatttaacattgcttcctttcatctcacacttctcatatgtccttctcctctagattctcagtgacgatgattttgtttcaaatttcattgaaaacattagaagcaataagaagagaactgccaaagctctcagcaccacatctacccaccttccagtacctattccatataccctgctttccctcttgctcctttgcatgaaccctgtgctcctactccatggaaacccttcacttgtgctctaggtatcacccctttcgccgattctaggacaatgctccacccacatctcctctttctccggcatccacttttctttttctaatggatcatttccattcatttcaacacgccattgtaatatcttccttaaaaataaaaaccctttcttgaccctatattcaccatcaattaccacccatttcccccctgttctactttacagcaaaaagtctatacctctggattctgctctctctttcattctctctcgacctcactcccatccctccacctgctatggtcatcaatgacctccatgttgccaaatataatggcagaatttcagctcttgttttacttcgctatgaagctgcacttgacatagttgatcattccacctctttgaaacactttcctcacttggcttctgggacaccactctctcactcttgattctcatcagctgagttgaactcagtcaactttgccggtggctccttatctccctgacttctgtgtttgttttttttttttttggagactgagttttgctcttgttgcccaggctggagtacagtggcgcgatctcggctcaacgcaacctccgcctcccgggttcaagttattctcctgcctcagccttcctgagtagctgggattacaggcatgcgccaccatgtccagataaatttgtatttttagtagagatggggtttctccatgttggtcaggctggtctcgaactcccgacctcagatgatccgcctgtctcggcctcccaaagtgctgggattacaggcatgagcaactgcgcctggcctctccctgacttctaaacactgtagcactcctggctctgctcttctctctccacactccctcccctattgatctcattcagtctcatgactaaatatcatccatgtgttgacaactcccaaatttacatagattcaactgcttctttaacatgtcccattggaggcctaataggcatttctagtctaatatgtcagcaggcaaaccctgacttctagcccccctgactgttcaatctgcagctttccccatctcagttgatggcagctcctttcatttgctcagccccgaaaccttggagtcacccttaactttttctcttgcactccacatccaatccatcagcaaattctccttcaaaataaaatcagaattgacctcgttttaccacatctatcactaactcctgatccaaggcaaattcacctccatatgctctctctatttctgttcttgccccacaaccaatctcttctcatagcagagtggtgatgccttcagatgtaagtcaaatgccactcttctgctcaatgctctgcaatgacttcccatctcccactgaataaaataaactccttaccatgagccacagggcctgtgtgatctgctcttccctatccccataacatctctaccctcatcttctgcctctcctcgtcactctctctgctcctcgtgctgctcctagaacaccccgagtttgctaccacctcggggcctttgcacttgatgttcccttgttctaaaacctcttctcccagaaacccacatggctctctctgtctctgtccttgttcatgtctctgcttcgttggagagaccctccttacccatcatataatacagcaactacatggttcctgacattccatattccccaattaataggtgtaaggccctgagtcaaggctcttaacagttctgtgtctctgttttctcctctgtaaggtaactatagcaagagcacccattctataaggatgctgggaggattaaatggattactcgatatgtagcacacggaagagtgcctggcacatatgtgttcaattaacacatatgtgttcagttattattattatttatttattttactttaagttctgggatacctgtgcagaacgtgcaggttcgttacagaggtatacatgtgccatggtggtttgctgcacccatcaacccatcatctaggttttaagccccacatgcattaggtgtttttcctaatgctctccctccccttgcccctcaccccccaacaggccctggtgtgtgatgttcccctccctgtgtccatgtgttctcattgttcaactcccacttgtgggtgacaacatgtagtgtttggttttctgttcctgtgttagtttgctgagaaggatggtttccagcttcatccatgtccctgcaaaggacatgaactcattcttttttatggctgcatagtattccatggtatataaccagccttgccctctgaagttgtccaccatggagatgttaaaattctgaaagttgagtaccggaggaaaaaggttcaaccacagagttggtgaccagaagccacccctaacctccctgccaggctctttgggcccctgtgcactgcatctgtaacacagcacagtggcccctgcccaggctggtggaaacaacacttggtgaagaatgggcaccaggaccaggtctgcatctactagctgtctgacattaggccagttacttgatctttctgagcctcaattttccttctttaaaatggagataatatctgcctgcctccctcacaggggagggtcacaggacacactgatgcccaaatacatctacatcatattcggtgtacatgactggccatttcaaataccctacaaaagatgaacaatgcccattattcattttcaagcttggggactatattaaacaatgcacactgcacatggagattacccgtgagtctctgtggtattcattcattcccaaagcaaatggtcattcatgacatttgtgctacagttttactggccaaggaagacactcagaaacgaatctagatctctcttccaacggtcaaaattagaaaggggagagggagtacatttcttaggcagctgctgcttggaagcaggtttgtttgagggttggggagcacagccgtttaatgtgggaagggtggttgtgtgcatgaggctgcactaggctgtctggagagcagttttagcccagagaggatggggcaaaaccctcctaggacatctgaaaaagccattaagcctggaagaaaggatcctacattggaaaatagaccttttctgctagaaacttccctcattctttctgtccctgaggatagtgctgggccacagggggggagaaaagcaggaccagaaggtcaagaaatgctgcagatgttggtgttgttttgttcttcttctttctttttcttttcttttttttttttttcaagaggagggaggcaggtatgagggagatcaaggcagccctagggagtatctaacaaaatggagaaccctggtgtgaccccagatacagatgtggagtgagcctggggcttccagaagggcagaatcagaggtaggagctgtcccatctcgggcaagcttccttgtccttccagaacaagggtcagcaaagcttttttgtatagggacatgagataggctgaaaaatgatccgcctccctccaccaatgatatcctcacccctaaagcccataaatgttaacttatttggaaaaagagcctttacagatgtgattatgttaagaattttgagatgaggagattatccagaatcatctgggtgagccccaaatgctcacatttgggcagaagaggcagagggagacttaagacaaaaaatgattagtgtaggagaccatgaggccagaggttggaatgatgtggctgcaagtccgggaatacttgcagccaggagaaactggaagaggcaagagagggactctctcctcaggccactgaagggaggatgccctgccaacatcttgatgtcagcccagtagaactgacttcggacatctggcctccataactgcgagacaaaaaatctagctggtttggggtttccaattctgtagtagtttgttacagcagccacaagaaactagtgcaagctagatagtaaatatctggggctgtatgatctccctcgcaactactcaactctgatgttgccatgtagaagcagccatagacaaggaacaaatgaataggcatggttgtgtcccaatacaactggggagcaaaggccctgtccaaagaatggaacagtgtcgggcgtggtggctcatgggtaatcctagcactttgggaggctgaggtgggcagattgcctgagcttaggagttcaagaccagcctgggcaacacagtgaaaaccctgtctctactaaaatacaacaattagccggccatggtggcatgagcctgtagtcccaactacttgggaggctgaggcaggagaattgcttgaaccctggaggcggaggttgcagtgagccgagattgtgccactgcactccagtctgggcaacggagccagactctgtctcaaaaaaaaaaaaaaaaaaaaaaaaaaaagaacgcaacagtgacagtagtgattcagcttcagtaggttcttgctggctggggacaaagatctgagacggccagatcctcctctttctcaaaagaggtgggaattacagatttttatgagaaattttctggatgtaattgttggtagctatcttcaattctggttgatgtcatgcagactgaagaaaaacacatctgttcagccatatctagcccttgagcctccaatttgcacccactggtctattgtatgctgggctctgggctgggccttgaggacagtgtctgttcataagaggatcatggtcaagtgagggagacagacacactgatgcagtgaagtattacagggcctgcaactgaattaggtagagggtactatgggggaggaaaggttgcttctatctgaagaggaaggagggagagtgaggaagggctgcagggagaactgatatccaaagtgagtcttgcaagatgagctggagtcagaagtggacaaggtttggaacggaactgccagtaggagggctggtagaagcaaaggaagggagatccggggaagcagaatgtgtctgaggagcaagaagttccagtgtgtgctggtcccaaggacaggaaagaaaagagtgagatgggcttggagggagaggaagggagggtcttgatgggatagccatgaacggatcttggattgatcctggggacaagaaaaaccatgagggtttgttatgaattgaaaaatgtaacctccaaaaagatatgctcaatccctcacccttggtccctgtaaatgtgaccttatttggaaatagggtctttgcaaatgtaatcaagttagaatgaagtcagtggattagggcgggctttaatccaatgactggtgtcctcataagaagaggaaatttggacacagacacacagagaatgccgtgtgatgatggaggtagaggttaaaactgggaatgcccaggattgctagcaaccaccagaaactggaagagataaggaaggaccctcctcccctcgagtcttcacagagatgaagccctgtccacactctggaggcaagaagactgggtagggtgctgttggaacaccacaggcaagagttttcaggagcctcaaataaggctcaccctctcctctgttttaagcattgcactttttttttttcttttcccgatatggagttttcttgcccaggctggagtgcaatggcgcacgatctcagctcaccgcaagctccgcctccggggttcaagtgattctcccgcctcagcctcccgagtagctgggattacaggcatgtgccaccacacctggctaattttgtacttttagtagagatggggtttctccatgttggtcaggctggtcttctcctgacctcaggtgatccacccgcctcggcctcccagctttgcacttttaaatgagcagagtgtttagaaactgaacaggggtcttgtctggttacccattccactcattcaacaaatgctgagggcctccgtggagctgaggcagataagacaaatgccaatcctgaagaaggcccccagcttcctcctctgacctatctgtctcagcctgcttggacagccataaacttagcagcagattttattttctcatagttctggaggctggatgtccaagatcaaggctctggctggtgagggctctcttgctggcttgtagacagccaccttctcactgtgtcctcatgtagcctttccttggtgtgcatgcaggagtgtggagaggtggactagggagcaagttctctagagtttcttcttataaggacactaatcctatgagatcagggtcccacccttctgaccttgtctaatctaactacctccttacaggccctatcactaaatacagctgcactggaggttgaggcttcaacatgaattttggggggacataattcagtccttagcagcatctgagccacaaacacctgtggaatgccaagagagtggtgacctggtcctccctgttcccacttcccatagcagataactgtcgacgaggagggtgactgaggcaaaagtaccccttctcctttgcattgcagtagaggacacatgtatccttagcctaatgcatcctccagtctgcacaacccagaagggtggccccagtcatacaaacttggcaacactcaaacaacccaccaacctcaaggtatcatggtagtatagccataagtccttgagatcaggagttctgctgccaaggctacattctgccacttcctggccctttgagataatccctctccacctctcagagcctcagtttccctttatgtaaaacaggatgattaacaatcatagctactgtttctaagtacctactaagggcttagtatctgttgtcagctgaaaaatggccttccaaaagatattcatgcctaattcctgaaacctgtgaatgttacctcctgtggccaagaaaaaggaagtggcagggggctgtagggggtagaggtttgcttatgtgattaaatgaaggacctagagatcaggagattatcctagatcacccaggtgggccctaaatacgatcacgtgtatccttatacgaggcaggcagagagagatctggtgcccgcagagagagagatctggtgccctcacagaggacgaggccaggcagatggcagcagaggtcagagctttgtgtccacaagccaaggaacttggacagtcatcagaaacaggaaaggatctcccctagagcctctagagggagcacaaccctggcgacaccctttttttttcagcccattgagaccagtttgggacttctggcctccagaaatgtgagggaataaatttctgtcattttaagtcacttggtgaatggtactttgttatggcagcccaaggaaagaaacacacacccattatctcgataaatcctcagagtcacccatgaggcaataagatagtcatgccttaccaggtgccaggtagtgttcattcaatattcacaacagcactaggaggcagatactgtcaacatcccattttacagattaagaattgccacccagagaagtgatgtagcttgcctaaggtcacacagcgggcacctgtgccaggctttgaatgaagggtctggctccaagttgctgccttaggccaccttgaggcgagctctttgcaccagaatggatgctctgtttcctgagccagtcacgcagccttgagcaatggcttaccatgctccctctgcactaccctaagtggcttattctgggatcctatgaggatcagatgggacagagggcatgaaaagcattttgtaaactgtaaagtgcagtgcacggagaaggcataagaattcaaagtggaagcaaacctgcttacctagctggccatggcaaggctaccctggtcatcactgagataggtggggacaccagcagcaggagccgccccctatcccttgagcacacacaggaaagtttctaagcctcgaagtgcccgtgggtgaactcacagatgttaccacccagaaccacaatgctgacctcacagcatgatcactagatgtcacgtgagttcttcaagcctgaatccagccttgtaccagctcatcagcacctcctcccgacctgcccttctccgtggctttcaaattcagaaccagttcctcccagaatcacataatttctttagctgtaatgactccttcattccacagagaaggagacaggcaggaacatttagtgacccatcgaagaccacacagctagtatattctatcgaaagcatccttcgtgtcccagctgtgggtctcggtattcccagctccccattcatctcaggcagctagaaattctttctggttgggagaatcctaaaaaggggaaactggcatatgggcacattagatttcatttcatggcctggagccagcctgctccttctttttttttaatccaattattatcacacagaaacctgtttaggaagaaaagtcctgactcggtgcaatattgtccccagtatgttggtagggactttacttcagtggatctgtcagagccccagatgccaagtctatctaaacattctatcatcagttcatcatttttgcatccatccatccctcattcactgagcttcctgagctcctgtgtgtcgggtaccgtgctagacactgggatataaagaatatccccaaagaaccctcagatttacagggagagaggcaagaaaataaataatagcagcatttctgaaactcacatattagcttttcttgcttatgatttttgtcattttcttgttatagtttactcttcatatttacttagtattttctttgaattaactcttttttttgtcttacttaaatgctagctttgggttcaccctaagcaataatatccatgaattcatggatttaattggctagttttttctgactacatgttgtactaaaaagtttaactattaaagaaagaattcctgggatgccacctaaaaccatcctgcgtctcagaggtatgtgaggcttccagtgagaaacactacattattgctaaggaggcccctacgtgttagaatagagtctgccagctgccactccaagaggacaatgcttttatcctatcaagtgctggctggtgaagacacattaggattaatggtttgataaacaacatctcaaggcaggacattctatggcaggaagcagataagtctgtgcctttcactcaaggatctcagaaacattaacttctcagttttcatgccctctaagtgggagacaaggctattctcatgcctcatttcctagctacaggaaaaggtgttctgtgatgtaagactgcatttttttttttgagacagaatctcaccctgtcaccaggctggagtgcagaggcacgatcttggctcaccacaacctccgacttccgagttcaagcaattctcctgcctaagcctcccaagtagctgggatcacaggcacacgccaccatgtccagctaatttttgtattttttttttagtagagatggagtttcaccatgttagccaggctggtctcgaactcctgaccttgtgatccacacaccttggcctcccaaagtgctgggattacagatgtgagccaccgcacccggccaagactgcatttttttaatctcctgtttccatcacaacacaatgacggatgatattcccatgggagccagtatcagggtttacgctgagtgaagcggaatccctaggacttgcatttaactgcagcgtcaccgaagaaagtgcgtcaaaatgcaagcaaaagaggatgacattattttgaagacaaccttcaacataccttaatttgtttcttaataagaaagcaacacacaaactccaggacttttactatcaataataaaaactgatttgtaacactttgctccaaataaatgaatataccattgtattgggtacttctcatttcctttattaatttattccataaatatttattgagcacctcttacgtgcccagcttgccttaggcactggggttagaacgatggctcaagacagacatagtccctaccttcatactactagtgaggaaggctgacattaatcaaataatcatccaaatgaatgtaaaatgtaatgtaaatccaaatgaatgtaaaatgtgatgtgtggccacagaggattgataggaatggtgaatgatggatttaaaatatgaagcaaccagccgggcatggtggctcacgcctgtaatctcagcactttgggaggccgaggtgggtggatcacttgaggtcaggagtttgagaccagcctggacaacatggcaaaaacccatctctactaaaaatacacaaattagccgggcatgatggtacacgcctgcagtcccagctactcaggaggctgaggcaggacaatcacttgaacctgggaggcggaggttgcagtgagccgagatggcgccactgcactccagcctgggcaacagcgtgagattctgtctcgaaaaacaaaaacaaacaaacaaatctatgaagcaaccatacaagagacatcactagtcacccctcattaagtttcttccacaaaccagattgtctcatttaatcttcgctgcaactctccgaagcgggcattattattcccactttacaagagaggaaaccttggctctgagcagtgtaatgacttacccaggggcactcagctggctagttgcagagctgggaatcaaacccaagctgtgcttttctcccaaatgcccagtctccccaggggatgcatgaataggaaaaacaggaccttacgtactttgcaggttactaccgtgatgtccttgctagcgactcctccacgctttagtaccatcaagggtccaggttgggcaagtactcgaacctccattctgccctgggataacctgggcagaaaagccaaacacagcaggggagcaggaacaaagcgctcccttttatggtgaggcggtgcaaacctctgcatctgcctccaggccttgccaaggcccacagagaaatggcctgccctaaagattgcagtgagctgagattgcgccactgcactccagcctgggtgacagagtgagattctgtctcaaaaaaaaaaagagagagaaaaaaagagaaaaaaaacagaaatggcctgccctgactgagcccgaagccttctgccctgatctctgcttttctttgtgtacctgtctggttacaaaggaagcagctgccagctcactggtgtgggacgccatgtctggtctgtgctttgctgaactgtgctggaatttcacgggctgaagctggccctggggggtgccgggaggtgaatgagagaagtgtctcaggagtgttgttctgggggctaaaattacaggtgatcggacaactgctgtaggagatggagacagagcagcacctgagttgactctaaaaccagagggcctctgtgcagtgcgctgttggccgctctggtttccttttcgcatctctgcagcccttggtattttctacctgtgttatcagagaatctctggctgaggaccctggaaatttctgcccccatctccacccttggaagcctttccacaaagagctttgtaattcaccaggtgccttgcatatgggagggattacaccttgacctcaaatatttgctgttttcgtcactggctcagagcctgggcactgaaataacactgcatggttggaatcctggctccctgacttaccagctgcatgaccttggacaatctactgaacttcctgtgccttagtttctttatccttaaaatggaggtaataataatattaaccacaatgtaggcttgttattataaggattaaatgatttcatgtaggtaaggcacttagcagtacccagcgtaataagcacttaatgagagcaacttggtattattgcctgcctgcctgcctgccttccttgcttccttccttccttccttcctttccttccttccttccttccttccttccttccttccttccttccctccttccttcctctctctcacccccttctttctttctttctctctctcttttttctttctttcccctccctccctccctcccttcctccctccctcccttccatcctcccttcctcccttcttccttctctgcatccctcctttcaataaacaaatccttttaaattgtataaagccctggaactaccaagacctgcaaggctcaatagctcgtagtcttgtccaaggttccacagacagaaaatggactcactgggaagtgccatcttttaggaattcactcttatctgactcctccatcatcctccctctcaccctcatggtgcctagcatagtaccttatagaacaagtacatcctcaataaatccctgagagcctgaatagatgatggtggttaaggacacaaagcttagggagcaaggctatgtgggtttaaatcctgactctatcaccaataggctacatggccttggacgagttacctaacctctctgggtttcagttttccccacctataaattggcattacgataatgcacttaccccacagggctgggctcaggcttaaaggaattaataataaaatgtttatatcagtgcttggcacatagtaggtgttacttaggtgtttgctattattattatattagcaaacacctaaggaggtgttacttaggtgtttgctaatattattattattattaatattattattattattgttgttgttgttgattggctgagctagggctgagacacaattgctatttgagagtctcccagttcattttctgatacttttctcctccaggactgccttaggattcttgggcacagagaattggattactgagtagatttacagcagactatgcttctcctcctcctttttcattctcttacaaaacagttttcttttttaaacagaacagacaagcaatgtcaaagatttcttatttcgcaatgaagttttccttccatgtgttctcctctttctatcttctcagaaggttgttttttccccttcagaactttttttctgaaggaaaattccatagtaagaaggaaacaaaataagtttcaggctctgtaatttttttttttttttgacaaagtttcaccttgtcgcccaggctggagtgcaatggcatgatctcggctcactgcaaactctgcctcctggtttcaagcgattctcttgcctcagcctcccaagtagctgggattacaggcgggtgccaccacgctcggctaattttgtatttttaatagagacggggttttaccatgttggtcaggctggtctcaaactcatgacctcaggtgatccacccaccttggcctcccaaagtcctgggattacaggcgtgtgccaccacgcccagctaattttgtatttttagtagacatggggcttcaccatgatgaccaggctggtctcaaactcctgatctcaggtaatccacccaccttggcctcccaaggtgttgggattacaggtaagatctaccacgcctggccaggccttgtaattcttttttttttttttttttttgagacagagtctcgtactgtctcctgggctggagtgcaatggcatgatctcagctcactgcaacctccacctcctaggttcaagtgattcttccacctcagtttcccgagtagctgggaccacaggcgcacaccaccacagccggctaattttttgtatttttagtagagatggggttgcaccatgttagccaggatggcctccatctcctgacctcatgatccgcccgcgtcagcctcctaaagtgctgggattacaggcgtgagccaccgtgcccagcccaggccttgtaattgtagcagaggatttggcttccctcagcctatggatctgcgccctgaaggatgaacaggaattagtgaagcaattctctattgagaaggagcaattctctattgagaagcaactctctattgagaggagttagttaagcacttctcattgaagcttcccagagagtagtgagaccagaacctgttattcccattaaacggtatgggaattgaagatctggggaagccaggtacttaatcttagtccacagcagagaactaagctcaatgacccccttcttatctttacttagcttctcggacagtcactaagaccgggtttctcctgtgcttcctctcttgatgcaggtttatattgcctggatgcctgacttggaagttcatggtacagttcagggccttgaaacaggtgagtatgacaaataacagacctgtggcctcagttggagagacaatacagaaggctgtccactgggacgggttggagtacacttgcttcatctaacctggacagcatcttctaagcccctgctaagtaattccttgcaatgtgggcccggagcttctggtttttcaggagaagctggaaactggaattactgaaaatctgaatttttctgaaagtttgtgaattacattttaaaatgcggcatgaaccaaacacaaggcatctgtgggccaaatccagccttgagattgctagtttttacatggtttttaatcttcggatttaagggggcttagaggatgtcttgtccactgttctttaccatgctggaatcccctgtgcgccgtctctgaaatacagttgttcagcctccaactgaaatacccctgctctctcctgctaggagtttgaaattcaccagaactcacagttttacttgctctttatcattataaacccctaatctaccacctggcagcttttaccctttggtcctagtgtcttttgggggaaactaaacaaaccaatctcatctttggcacaaaccaatctcatctttggcatgaattctgcagccaaactgcctggattcgactcccagcaatactataactgtgtcgtggtaggcatgtgacttgaactatctgtgcctcagtttccttacctgtaaaaaggggatgataatggtatttaccttacaaagttggatgaggtttaagtgagctaatatattcaaaagtccttggaaaggcaatataagtgtttgttattttttcctctttctcaggttaaactttgcaagtgcttccaactatctccagaccctgtgttttctggggcttttgtcattctctctactctgtttggagggtgagccaacgtggctcccttgatccctgactcttggtattcacagccttgcctaattcctccaccttgagtgatggtggggcttgtgatatgcctttaaccaatagaacatggcgcaggtgacagggcatatgcgattatatgaatatgaacaatcatgttacatgaggctggaatgcccatcttgggaggaggcactttttcctgctggctttgaagaagcaggttgccgcatggtgagctgcctgtggagataatcacatggcaagaaaatgagggtgaattccagctcacagccaggtagaaactgaggaaccaaatgttgccatcaatcaagtgagtgaggaagtaggtgcttcctcagtcaagttccagatgaaactgcagccctggctgacatcttagtttcagccttgcagaggagccagctaagccatgtccagactcttgtctcacagaaatcatgagataataaatatgtgttatggtaagctgcagagtgtatggcaacattgtcatgcagcaatacataggtaactaacaacaatggtaactctccctcacctaccttactttggaagttctctacttatgtcagtgtcctatttaaaacagaagttctggaagagaacagcatatcgcagcaggcattatttgcacactgcatgagctgtggccataaaataatgttgctgattttctaatgggcacgagagaacaaatgcatgcaaatgctcctgtttataccagggcagggcttgagccccaactgtgcacaaagcactgggctggatcttctgagacagaggagccttctctccccttcctgcctccaggtatgatcacttggtacaagtgatggtggcagctgatctgttttccttcctaattctcttccctcttttgttacttttctttattgaagaggaggcagaggaagaaaaaaaaaaaggacaaaaaaaaaccaggtgaatgcatatagtctgttacagctggaggggatgagaggggtcagtcggtgcagctctggggtcagtcggtgcagctcttgttgtggagggttatacagagactccatggctcctaagtgatagagccagagttagaacgtctttgacacttggcccagggctctttccttcaattacaacttgccatttttttccttgtgagtactaggaagttgacaccatgcttccgggtagagtcttgggtgttacatgttgtcagagggtccctcgtactttctttttgttcttggccaaagggatccccttctctgaacctcagtctccttctctgtaagatggagtcctggggggctgatggaataacacatgctggctcccagcaagtgggagagaagcacttggcttgctcccattagtgtgttcttctgcaaggatttcaaatgctcgtgcatcccactgtgcattcaagtgttgggaaaacatttattgtgcctgacattttcccagagagtgttttctcagattaaaagaaagtagtcaaactttccccttctctgattaccttaactgaaggagaccctatatgctccacatcccacaagttactctgtcttatcatcttcattgcactcatggcccgctgagatggtttatccatctgtttctgtgtccaccaggccaacgcaagctctctcagctctcagaacaggactgtgtctgtcttgcttcctgctctgtctctgtacccagaacagggtcaggcctggtgtaggggctcagtaaataaagcctgaatgaatgacagaacctgtcttgcttttgcctatgagacttggcctgagaagaaggagaaatccaaggaattcaaaccacttcaaagaagaagaagaagaagaagaagaaaaaaaaaatacagcattctagcaagatacaatcccatttacttactgcacactttccacatcccaagcagtgcttggcccttagggctcccatttaattgggatatctcatttaattttcatatttgccgtatgaggtgggtgctgttagtgcccttgtttgtagccgaggaagctgagttccagagaagcaaaatcttttgcataagagcacacagtgaggtacagttagggtttggaatgcaggcctgtgtgcctccagggctgaactgctccacactacaaaagttgatggtgtctttatttctaggaagtacatattgaaatattcaggggaccaggagcatcatgtctgcaacttattctttttttttttttgagacagagtctcactctgtcacccaggctggagtgctcactgcaagctccacctcccgggttcacaccattctcctgccccagcctcccaagtagctgggactacaggtgcccgccaccacgcccggcaaattttttgtatttttcatagagatggggtttcaccatgttagccaggatggtctcgatctcctgaccttgtgatccacccacctcagcctcccaaagtgctgggattacaggcgtgagccaccacgcccggccctgcaacttattcttaaacaacctaaaggaggggggatttaataatatgttaacatttggggaatctgggtaaaaggtatctggtaattctctgaactattcctgcagcttttctgttaagtgaattatgtcaaaataaaacattttcaaaagctcatggtgggaagaagatgagactcatgtcatgggatgaagggcacaggtcctgcttggctacaataaagagggggaatgggaggctggggcagactctgggggctggaaggaccaggtttcatcagggaggcagtgttcaacacggataggaccagtgatgatactctgtctttaaccaagtctacccatacttcagcatcccgaatgtgccaacttcttttttttcctttcttttcttttcttttttttttttttttcctcactctgttacccaggctagagtgcagtgatgcaatctcggctcactgcagcctccatctcctgggctcaagtgattgtcctgtatcagcctcccaagtagctgagattacaggtgcgtgccaccacacccggctaatttttgtatttttagtagagataggatttcaccatgttggccaggctggtctcaaattcctgacctcaagtgatcctcttgcttcaacctcccaaagtgctgggattacaggcgtgagccaccgcacccaaccctttctactgttttctagagtagctgtctgtgggggaaggttatatatatccatcctaaaatatatgctttcagatcagacagacctcagtgacatcgcttcctattggtgcccttgagcaagtgatttaacctccctgagcttaagtcttctcatctggaaaatgaggatgatgatgtctacctcactgggttgttgtgaagattcactatttcaaaaaaatatttactgagccttgatctgggataccggggacagagcagtgaataagacaggcatcttgcactgttttctttgtgcagctagaaacactaattgtttagaattaaaggacaattaataaacattttaataagtttttttcagatactgataagcccagaaaagaaaaatccatgtgaaaaatgagaccctgggaggctccagtgactggggatggctgtgctcctccgctgcggcacacctccccgagaaggtaatatctgagctggaagctgcagaattagaaggatctgactggccatggcaagacctgggagaggcagagggagggtcagggcagtcctggagctgggactgagtttggcttggttaaaggaggaaaaggaggtcagtgtagtgtaaacacaagtgagagtgggagagacatggacagccacagcaggggcaatgccacgctgggtctagaaggccaaggcatttagacttcaagtgcattagggatccaccatagagttttgagcagaagagtaatatgatctcgttttttttctcttgaaatcggataatccagtcagccctctgtatctgtggattccacatcgggattcaaccaaccgtggatggaaaacatttggaaaaaacaaacaataaaaaataacaatacgactatattaaaaaaaacatgaatttggctgggcgtggtggttcacgcctataatcccagcacttttagaggccaagatggacgaatcacgaggtcaggagttcgagaccagactggccaacatgatgaaaccccatctctactaaaaatacaaaaaattagctgggcatggtggtgtacccctgtaatcctagctactcaggaggctgaggcaggagaatcgcttgaactcagaaggcggaggttgcagtgagcagagatcgtgccactgcactccagcccaggtaacagcgcaagactccatctcaaaaaaaaaaataataataatatggatttaaaaatacagtataacaactacttagtatttacattgtattagatattataagtaatctagagatgatttaaagtatgtgggaggatatgtttagattatgtgcaaatactataccattttatatcaaggatttgagcacctgtgaaagtcctggaatcaatgttattaatacaggacctgaaacatgatagatatttaataaagaacagctttattattgtttatcatgacttggcattgccactagtcattacggacttctagaaggtgggcggcctgtgcctaccttcattctagaggcatgcatcttggtgcacccacctgcctggggaaaggggagaggagtgggaacaactcgggacacctctgacttccttcctcctccttgccacatgctgcccccccacccccaacaagccagatgccagtcacctctgccaggccaaggggcggccagggtaggattgctgggcccccctccagctggctccggctccaggcctctgagccgccttcactttgccttaaaaatgcaaagcattccagccattttaattactgggcattgcataagccagcaaccagttcatacaaaggagcaatagacaaaaaaatgatttttcaacatgccttcagcctctccccttctttcctcctgaaatcagcccccaatcactgcctcccaggcctagaaaaagcactccaggtatgcacaatctctttttgagtttgttgatgtgacatcaaggtcttttttctctaaatacttgaggcaaaaagcagttccagccaccttcaagtgttttggaaagttaccgatcatattcctacttgacatgctaagacaatcagaggactccatattatatacactgagaactctgatataaaacagagttcattgtgcagtgggtctgtccaggcaccaattcagggcgctttcagttctggaatgactttactatggggtactcctaagaaatgaacctcaaacacaatgttccagcaatgcttttgtgtggagaattattagtacttaaatatttatgtgattggggaagcttccatgtttcctaattctgatttttcagtagcctctaaactgttttaactaaatttaatccaaaaatttgttgaggacctactgggtatcagtattggttacgttcttggaagaggaaattcaattagccctgtcaattagctcactttctaaagagggaaagttacacagaaactgacaatcccagtacagggtgatgaacttcaagttaggtcatctctgatgggtgctcccagcttgggtgggaggaaaggctacttgtagattgtcttaataatattgacagtgactattcactgattggctggctctgtgccaggaattctgctaaacgctttccacatatatcatcttatttattccttgtaactctgtgaggtaggcgctattgttgtccctgtatcacagacgagaatacggaggcacaagaatgttaagttacttgtcgaaggtcacacagttaagaaaaggcagtagtaagctggtaaatatttaacaagtagctctacagtacaaagagccctcatttgcagtgtttgccaatttctgtggtgtaaatacttccatcatagccaattttaagttaccaaggtaatgttcctaaatgcagtagcacatcattatataatatttccaccatacagaaacaacagatgaaagttaccctgaaagcataaataagagtatactgtaataaacaattaaggagtgaggagtttcaagtgttcattaatataatttattagttataacattatataattaaattaaactttatttatttatttatttatttatttatttattattgagacggagtctcgctttgttgcccaggatggagtgcagtggcatgatcttggctcactgcaacctccacctcctgggttcaagcaattcttatgcctcagcctcccaagtagctgggactacaggcacgtgctaccaagcttggctaattttttgtatttttagtagagacggggtttcgccatgttggccaggctggtctcaaactcctggcatcaagtgattcgcctgcctcggcctctcaaagtgatgggattacaggtgtgagctactgtgcccagccaaaattttaaataacgcctatgtttaatgaccgacctgcaaattcccgaatgtataacaataggctctgacaagccagggtgagccagctccagtgcagcactggggtctctagaaccttgctcttcaccatcgcagacaagtaatagtagctacgagaaaaggtcaagggaacggaatgaacaaagacctaagatgtgactaccggagaaaagaaacacaatcacatttagtgttcacaaaatctttttaactgatcactagagtattcagagatagtgaggagtgcaggatgggacgctgaacttggaaatctccaccacagattaactgtgtaaccttggctacattactaaacgtctctgtgccccagtgttcttttccataaaatgggcatgatcataacagcccctacatcatagagttgtgtgaattacatacctttacacttgtatattacatagaataggacctggcacatagcagcgctcagtaaatgttagttacttattgtttgatctttgcagctgcctctgtgaattagatgtttgccttcgctttatagggattcaatttacgcttagagagcaatgcaggaggctggaggagataggactcaaatgttctgattctaacttcggtgcttacctcaagggctggaaggcatattgacctggctgagtactgttctccaagaggggctgccgacaaactcaatgccctactaagtgtcacttctgataggggccatatctaattaatggctcctcacccttgattggcgggtacaggcattctgggaagaaagacccatctggtttcaggaactgggcatctgacctttgcatcccttcttattttccaaacgctcgccttctgcttgaagaggcagagtggtggggtagttaagaggatgggctctggcttccaattccagcacggcagcatactggcgatgtaatcttgagtaagtgacataatctctgtgtaccttagttttcactgcggatgtgaaaagggatggcaacgatgatctcatctacctcatggcttttgctataagaactggtacaaattaatatatgcaaactgcctagaagaatacctggtacccagtaggcactctataggaattagttatgactatcaaatttttttattctcttttgcctcctttcttccatcccttctttgagtattaattacaaggtcaaaggggatataagcacatgctctttctttataaacacaggtcactagactataggctacttgagggcaggggctgttctcattcacctttatacccctggggccacaccctggtatacacagtcctcagtgagaatttactatgtgccaggcactgtgccatgcatcttattcagcttacagtgtttgatcttcatgaaaatcctacgaggtatgcatctctcctcccttttagcacgagacagctgaggctcagagagaggttaaggaacttgttcaaggtcacagtgaaaaagcaaagaaggataaaactcagacttatgacatcacaggccttcgttggttcctaacctccctgttgggctgccttctagaatattccatgggaaattttgagagatcgttaaatccaacccacttggttttacatttaaagaaaggagtcactgatttactcaaggtcacacagctattttatgtggtaggactaggataataacctggtatattgcctcaatctcatgtttgaaatttcaggaggaaatgaagccaggttcattagctgttaaaatatactgatgagtatgccaccagcttgcctctggttctgggccctatctacgtaatacgaatgtaaatttcctatggcatctatcaaaattttgagtaaggaagggcacacccgcacccctagaaattgcctgccaagtcacttctcctgccttctctccattgcaaaccaaatgaaacagagatgcatctcacttgcctgcagataaagctctctccctggtcgtcagaggtaggtactatgcttttctctgcttggctgcatcaagagctctgagcactcaacgagaacccaagagacaaagagaaaatcaccagtgctgcaaatgccccaatgaacgtgtgggcacattgactttgaagtcttcaggaagagtgctggtttggaaagagacccctgcatctgaatcacagctctgccacttccttgagtgtaagaaattgaacatgcaatttaacttctttgagcctccgtttccttgaccataaaatgggcataataccatagtacctagtacctattattaagggttgtgaggattagtgggactactgcattgaaagtgccttgtacatagtaggtattcaactaatgccaagttcccttctcttttactcatcttagaaacatttttcagcttatcattccaaggttgacgagttgcagagcagggagatgattatttattgattatctctcatgggcccagcctgaattagagcagcctggagtgacgggaagatgatgaggtactaaggagtctgattctttgtttgcttctgccaataatctggtgtctacctctctaggcctgtttctgtatctgtaaaatgagggagttcaacttggtaacccacagctctctcctacttctgaccttgtgtcttaccataatctgagttcctaaacaactccctgctgcctggttggataggtagctctatgatctcatggcacacttgactatcccactgtagttctttccaccaactattattttcttgtgtttttctcccagaagactgggagctccttgggaacagttctatgccttgttcactgttgtatcttcagggcctagcatggagtaacagacattctgccaatgtttggtgaatatttgaaggaaggagggaaggaaggagaggaccctgcccctatcctccaaacacttgatcatcacactatgacacataagatgtgaggcaaatggagaatgtcagtggagaattcatgattaagcacacacccagaacttggaaacaaggtcatctgtcttactgaagccatacattcatgcaccatgcttgtgcttagccatctgtggtaataaatcaagacacagcaagggcagagttgaaaatctgggaataccagagcccaaactagttgacctgggggtaatctttgaatggtgacttgtatactaaaatgtagaagccaaatgaattccaatattccaagtgcaaagaaagtgttggggaagagaaggatggagtggccagcctggtgctgagaaccaagaagatccaagagcctgcagttggcatttgtgtgtccagcattgtccctgttcaggaagagaggctttggccagtggttgtgagcactggaatttcctcagcaaagcttttgcttccatgaaaaggagaattccagggtatctcagctgaaagacccttcctatgatgccctcaatccctgtattctgaatctacacacaccacagcaaccttctgaggagaaactagcttcatattgaagctctctgtgactatcaggaggaaaatatgggggtggtgttgacatgagtcctctagcctatgtgacaatgaaatacctcacgggaaacaagcccagtgggattttggttggtttgctgagctcttaggatcagtccgtgagaatgatcaactgagggagcctcatctagttgagtttctggacccaaggagctggattccagaacctctgttggggtgaatgtgtgacggtgatactctgactcctccttttctccactccattcattggttagtttattcctttaatatttgttcaatgtctactatgtgcatatgatgtgttaggcagtcacagaagcacctggatttgctcgatatctagaagagaaccagggatatcaaccactaggggcaacagagtgtgcgaggtgccaagctggaagcccggaggacccagtgtgggtgggaggtgagtgagagaagaggagaggcctgagagggggtggtccattctgctggggcagagagaggaccggaaaatattcactaagtggtgactctagctgaatcctgaaagatgaatacgtgattcctggcagatgaggtggaggagggtgggggaatatattggtggcggctagattccaggccaagagtgcattgtgaacaaggctcagagaaaccgatagctggaatataaagggttggaagagggcagcatgggtttagagagataagcaagaacagagcctgctgttgtataactgcaggggcagccatctcattgtattctatgtgaagagggcctcctccagctgtggaccgtggggccctggggatgagccagatcacagagggccttgtttgtctttggagcttaagactttgttcagaaagccacggagcacaagtgaatcatttcaagcaaagaatagcatgttttcagatttatattttaaaaaatgtacagaagcagcaatgcaaagttgaagttgatagagaaagactctggggagtgtaaccaattatgtcactattgaaattgtcaggaaagaatccacaggggcctgatccaaggtagaaatggtaagaatgagaggaagggatggttagaagagatgtggatcatgagactctataggacctggtgagtgatgatgtcatccttcggaatgggtaaccccggaggggactgaggggaaaagacaatgagttttggacacctggagtccgaggaggccataggatctctaggtgaaattgggcaggaggaagttggagatagaagacaggcaatcagagggacactgttgcttgcagtgtgcactccggtgcacatagcatggtagcgaccatgggggtgcgtggggtaggcctgggagagtgtggaggctaaaagggaaggggagagagccaaggacagaaaattgggaaacagctacattttaatttcaggaagaacctgaggagtctgccaagaagactgagaaggtatagatggagaggtagaaagcagaatcccagagagagtagggtctcagcagccaagtttaaagaaggatgcgatcaatggtgttaactgctctttggactgtccccacagcacaggacaagaccatatcagttccagcaggttccactgaagaaagctcatgtgccttgcagaaacaagacctccagcccagtctaacaggagaccaaccacatgtccatcccattccctcccaaggcatgacagcacctggctgagatgcttgtgtgtattctctgtgtgaagctgagcatgcaaccttcaaagaaaccacaaaggagctactcgtttttaaaggaaaaacacatgaactccacgggcataaggaagacattaaaacagggttggggagaagttcttctccttccatttcatagtacccttcacagaaataattgactgcttgaatatatggtcattgaaacatacatacacacacatacatgcacatgaaaacaagagctggaatatttgactctgctttccatttcccaccaccctagataacacaggatacaacatggctttactgcacacatgtgttttctggcttaaaaacactgagagtagatccctgtggaaagaaatatgaaaacctgaggattcatgcgaatgtagccagaggcgaatgtagccagaggggtcttcaatttgctggcagagctgggggagagctggggcaattttactgccatgaaattggctccagatggaggcaaggaaaggtgtttaccccctgctggtgccagacacagagagatcctgcagtacctcgcatcttaggctcagaattgcccagtgctgggcagcagccccactgagggtctggccagagctcatggggatgggtggaccaggctgtctgttgcttggaaaaggccattttgaatataatgactttcacatggacggtggggcttgggggaaggcatcgtggctagggtctggaggggaagagggaggaaagcaaagaggagcttccctatgaggcaacagaaatgacagtaccttctccaggttgaatttccaaaacccagctctgccctggaagactgggactgtggcatcctctgcagtgttcccagaccgccctaaggcccccaaaccaatgattcacaactatgttgcttccccagagagcatctccccctttggttgacatgtggccagctcaggggtggaggagctccggcagccacgaacccagacgggatgttgactgagagctttgtggccatggcagatgggaggggtgagcttcacccactcaaaggcacccgcaccccaccgatgagtgtggaattgtgctctcccgccctcgcagtgagacgaccgaccaggactgcaggctgagcaaatgggtgttctctggcttatagcgccccctagcaccagccagcgggatagagctccgtgaactctccaaggagccaccacctgcctgtctgaatgctggaaaggggtcggtggtgctgatcattggacccattcaaccaatacttattaaactcgttgttaccaacacttaatccctgtgttctaggggcttagactccagcaagggaaacagatgggtaaataatcacattagagtcagctaagtattgtcaaagaagttgatacagggtgttgtggggatacatgggaggggaatcagaggaggtttcccggaggaggtgacatctaagctgaggtctgaaggatgtggaagagttcagtaactcctgaagaccaaaaaaatggtgataaaaaagacaccttcctaactttttagtgctacgatccaagagacaaacaagcaggtgaacgcataactacactgggctccaccataagccagagcctgtctctcctaggactttggcatcacaatcttctctgaaattctgttttcggcattgattcttgggggaggtagcaatataggaactcagtgttcgttgcgaaactgatggatggtcttcagtcttgggtacgttcccatgtgtcaaacctgtttaaatggcaggacccatctccccttcagaagcattcacttgtcctacaggattccccatggaatcttggagtttttgaggcgagagggatcctggataccactgagttctatctttcatccaataaacacagaagtggacgcctggacaggcaaagtgacttgaccaaggcaggtgcacagctattctgcaacattgggaacaaatctcaggtcttttgattttttgtttccactttactctcttttcatttcccagaaacaaagttttcatgtgcttttttttatagtgatatgtttggaatgcattagctagtaatttaggaagggaaaaaaataaacacacaagagataaacctgtcaggaggacaaacctgtattgcttctgattggctcagagggtgattattatcatggtagagaattatttaatcagtgtaagtaaaatttctctgtgggctgggcactgtacaaagactcaaacgaatctgtctacagatctgaaaagcagatacgagatctgtgaatggctggggtttccaagcccacagtacaagcatgggccacaccttacagcttggaggactgagccctgaaaatgggcaagttccttcacttctctgaaccttatttttcccacatttaaaacaaggatgagtagtttctgaggtcctttttacgacttctcttcctacagactctagcatcctataacttgatacaaagagggtggatatgaactcacctttcctagaaaagttccaggaaagagaataccaggtcatcctagtaggtgtgtagacaggccagatagatcttgaaacttactcagttcttcccagatgtataactctatcattgttcttagctgtcaagagaaagcaggagagcctgcatcttcattctttttttttttttttttttttttggagacggagtctcactccatcacctaggctagagtgcagtggcatgatctcagctcactgcaagctccgcctcccaggttcacgccattctcctgcctcagcctcccaagtaactgggactacaggcgcccaccaccacacctggctaattttttgtgttgttagtacagacggggtttcaccatgttagccaggatggtctcgatctcctgacctcgtgatccgcccaccttggcctctcaaagtgctgggattacaggcgtgagccaccgcacccagcctgcatcttcattcttactgttagcctcaggttcaccccacctagcttattaagtgatgttgaataaccaattcttacatattattaggctcatggacaccatgacatccagactgatgggtgcctgctgaagggggtgaccctagcaggaggactcccctacgcaaggattcatggagtttgctgtttcttttccttagggtgagaaccaaactgccttcacacggtgggcagaggggaactgactcaggtttggaataagagagaacatcccaactgaaaagctcttggaattcgctgaacttcaagacactgtgtggaccagcttaggatagggagtgagaagaaattaaccaaaaggtaatttcgttacttttcagctggaaaaaagatcagattatacttgtgctttcataattaagtagctgctggaaaaaaacgcttcagatgctttctatgagaaaactgctgcttgaagttcagcagaagttatctacttgatacttatattccaggcaaggccttccgttggagaaaatatcggcactttggacaaaactgaaatgtgaaaagaaagggaagagagggcctctatcatgtaagatgcttatccaaagtggatttggtctggaaagtcttctaaaaccttccacatgactgtggaataagtcatgtggggcgcggggataagcgaatctctcaaattccaccacgtatgccctcattcaacctggatccttagagtggcctccagggcactctgctcaggactcagtcagctgttggccacacccatgctctccagtctcctgagaccctatttggttctgagagggctaaaaagcagtgtggctaaatatcccaggcctcaaagtattcctactgtggttggggaagcaatagaatcataccccataaaacaatgaaaacagtgctagaaaaacatcgagagacagaaacatctctacgagttaggccacagttagagtgaaggcagggaaggtttttaaagctgggtggaggggacaagtcaaaaagatgtggaaactggtttccctttcctatggctaaagtgctcaaaggggaaaaaggagtttcaaaaatgttcttggaaataccatctctcacgaattcttcggcctctgctgtcccaatgtcacttgtctgagatgtaaacagaggagttctgagaaagaagctgaacttgcatttctccctgtttctatttgttccaaacttgtggcatttctaacaggatgaagcggaagagaaagggaaagagacaaaagtgtagaaagatggaagatcccagctgcaaatggccatttgcagttagatggaacagctgctgacgttcagggaaatgcatgtctctcttcagatgggaaggagcagtggaaaggggtgacgagttcctggctggccaccaatcatcccatctttctgtgccggttcctcatctggaaagtgggagtgatacttgtgcttgcttttcctacccacaaagattattgtgagagctataatacggtgagatacagaatcctgcttttaaaaatacaaagcagaatcaagatgtcaataataaggatagtaattgtgttagttatctgcaatcatctattatagctagtcgtctaggatcctggatcgttctcctggttttactacagttttggatcagctcacccccaaatcccttgctgaagggtggagctctgtcagccatgggcagggaaccacttcctcttgcctttctactttctgtctttcaaacatgcccagggtctttgcacttgctgttccccctgcctggtacctctctcctgtggcttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctgcaaacagcagatggcttcccatatcccagagagtaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgcgccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcggtaagcgctcctggtgccccgcccgagccccacgctgcagccaggactgcagcgctgcttagggaggcagggcgagccccactcctttcctctgccccaggagaggggcagacggggttggggcggagtggagaaactcgatgtccttgggcgggggcgctggcatagctgagaggggaagatgccctgcagaggaaactcacagtggctgagggagcccctggccgcctttgctttcctaacttaggtcgtgaggttcctaccggtccttttgacatctggaaaatgtccccattcactactaacggaggaagggctagaagagaagggtggggaaagggttcccaaaacttggaatgctaactaaagtgctgggaaattgaatagttaaaaaaaaaaaaaaaagttgcccgccatgtgcacggaaagttgcaggagaaacttggagtactccgagtctgcatcatctcctgcgcctatgaaattcattcttttcactgagacccaacccagctgcaggcttcccaggcaagcgctaaccgagcttctgggactgccaagtttgggtggatttaagggggaaaatgaggagaaagctgtggcattgacccacgccctggaggcactgtgtttgagagtgttgatagccagcagaaggtgcgaggggtcactcaccacatagctgtgaaaattcacaggaaggctatttttttcccccttgaatgtgtgtggggagggggagaatgggtagtggaaaacagatttgtcaccaaaagaacaaacctgccaagggtcacatcacggtgacagttccagactggacttagtgtcttgagtagagagaccctgtaaagagacctcctactccttagtgtgtatggagggccccgagagcatcctgggaggcttgtctgggagtgtttgggacacttgtgtttggatggctaaaggtggagtggcatctgggaaacatctctctcctcctttccagcccataaagcgtgcaagtccagtggctctgctgggagagtgtgtgtgtgtgcactgggctgggctgggcggtggggtgggacagccttgccgccctctgcctgtgtcgattcagaggtgaagaatggagcgtgtgtgttttaagtacagtcataaaggagaaggaaattttccactgagtcttgggtgagggactctaccagcgtgttgtggtgaggagggggaggaggtaggagcttggcaggggaggcagtgagggccgggaggggcactgctggtgggctgggctgagcctagaggtcagagtgggggtgtggtgaccagaatgtcagtgcagttggcagctgagggtgtttgtgtgacctgaggtcacccttgtaagaggctccctggggcctgcatggtacatcctcccctctcctgggggaacccagctggcccaggatttgtggattgcttagaaagatccttttgggcagcctgaagactggggagggttttcctccctcctccacctccacccacattccacttaccctttccctcctcatcccagttggtaacattcccacctgattagtgtggggagttgctgctgcagctgagttctggttttgcccagcaggatcacacacgtgcggccaggaggctggcaggtggaatcagggtgtgcaggggtgcagcccaagtccttttctgctggaaaatgggctgggtgacttcacttgcgtttttttggtatgtagtgggagtaggtccccattcttcccccttgccctttgctttggggtttctaccctaaaaattgaccacggaaaagtgaaaacaagcatgagtagatcctgcttccaatgggggccttcccgtctgcttactgcttaggtttcctgcggtgggtctgagcaatgcagaaagtttcttacaatttctctggattgaaacaagaaatagctccctcgctcctcttcataaatttctcagagaaaatctaagttaccaggaagtagccaaagaccaggagattgtggaatcaaaaagaaaaaaagaaacaaaaaatcttcgatgctctggcacggatcccaaattgttctgcctgggtttggtgagctgcactagtggcagggatgagctaatgcttttaaaatgggaggtgtgggtgtgagctgcttgcctgccgacctccctcgccttgcacagcaccctgctggcgtccagtacttggctcccaagtttcattgctcagagcctttctggtttccagtctgggttgaaactgtctattctcgccctcaaacaaatatgaaggagctccccattccttgggacccacacaaccccaccagtcaactttgtagccccctaaaggtgttcacatcagcccatcaacttcctgttttaaaaccatcatggtggttttctcttcatggcttggtgccatgttggcctagcaaaaggcacaggaggcctggcctggtcctctccggggggctgcccgatggcctttcctcctgtctctgctcatccacaggtgtctctttttgtcttttttccccaaagtcctagggcctggcatggcattctgggggaggaggagttaaaaggtgtttctatggcaactccaggccctgcaccctatggaagtgtttaggagaagaataaactacatgccggcttataagacacactgtgggggaaagaaagggacttggcagcaggcaggatgtctgtggtccccctccctggccagtcattgcccctgaaactcctgacaaaaccttgactctagaagaggaatgggagggggctggagatgaagaaggcggcctcggcccgggcaaatctgccctggcagctctgtccagctcaggaaggggtgggctgtgccaagggctttctgaaaatgtgcgtgtgtgcgtgtgtgtgtgtgtgcgcgtgtgtggcttctgcaaaggtggctggcagggctgaggggggttgcagcagagaaagagaattttgcttcagaatgccaagcccttctctccttctctcttgccgcctttgcatgggaggaatggggctgtaggatgaagtgtgttcggggcctgcctctgagcctgttgggaatttgagcatgaggctcagctggggggccggctgccagccccagaggatggcccctggatagctccaaattgttctgacaggggccagtgccagcagattctttcagtatcagatctgaggttgtcgttttagcaaagaagccattttcaaagaaaccagatccatcccctctccctcttacacacaattacacctcaacactgggctttgcaacttaaggaaaatagaaagaatcagactttggagaggcgccagcacttggtagggcaagtctgggggacccaggctgtggatgtcttggaaccatggaaggaggagagctgctatccagctggaggagggaagagacatgtcttaggcccctcctggttgcacgcacttcccaaatgccatctctttcaccccctcccccgaccccccacagcaaccttaagagtaggtattgcacccatttttcagatggaaaacactgaggctgaagagactgtgcttgtccaaggccacccagttgctaaatgataaagctaaaacgtattatcagttataccatgcttcaaaaacctttcaactttcattgacacatgacattctaaggtgaccaggagatggaatggatggttaacatttgaagaatgcttttcttctacatctgggttttctttaaaaatatgaagatagccaaaatggccagaggttttaattaaacatcatctttagggagggagagcttattattattctagtgtatcatagaggaaaattctaatgttctttggctattagatctggaaaagacccttgaaaccatcaagccacagtaataaaaggacttggtttgtctcactgtggcccaaggagaagtaaggttaatagagacaagacatttcagggcttcaagactcttcccttaaaggtgggatcagttagggctccccagtgggaggtacccggtctgccagtgtggtaggaggaaagccagggggagtcaggagactgggtcccagctggagaaggtgcccctctgacagttctgtgtccctttcacagtccctggatagataaggctagaaaagtggccacagaagtagcttgggtggagggatttttgtttgttttgcatgaacagcaggaaccattcagctccactgctgaatggcacattccaacaggttcattaattaaaaacaaaaacaacaacacgattctccatcgcacttggcttttaccattccagccagtatggacaaggaggccccttcttctaccttttgtcatagtctactcctgggtggccttgagaggcagggtggagtggtggaaaggcaatggggagggcagatctgagctccactccttcctctggggcttgttggctgtgtgtgcctaggcacatatgggctacctttgagctttagttttcttatttatacaaggggaataacaatttgtaccatcttggcctgttttatctatattttaaaagctacaagtatatgaatacattctatgtccatgtatgtatctctctgtatatctatgatatatccatttctatttatcatttatcatctatctatctatctctctatctaaaatcggagaagagtaaaatcctttctgattactttttctaactctagtcccttctccaaatccttttcttcctatacatttacatacataggtatccatagcaaatttatagtagtttttcccttagaaacatgaatagtagaacattaaacatcatggaataccacataataccacatatagtattctgcttgtttcccattcaacaatgcgtactagagatctttctacttaatatatatataaaactgtcagaggagcaccttctccagctgggacccagtctcctgactgcccccctggctttcctcccaccacattggcagactgggtagctccccctggggacccctaactcatccccacctttaagggaagagtcttggaaccttgaaatgtcttgtctctattaactttacttctccctggccacagtgagacaaaccaagtccttttattactgtggattgatggtttggaggatatatatatataaatatataatatataaatatataatttatatataatatataaatatataatatataatatatattatatataatatatattatatataatatatatatattatatttacatatatattatatatataatatatatatttcttttatgtatttcatgaggttataattttaaacagctaataagtatagagtgattactatgtgccaggcattattctaagtcattaacttacattaactcatttaattctctcagttttatgagggaggtgtgctattgtcatctccattttacagctgaggaaactgaggcttagaaaaatgaggtaactcgtttaaggttatactgctagcaaggaatacagcctgtatttaagccccttcaccctggctctaaaatatatttaacaactatactataggtcacattataccatatcatattatatatactactacatactcttatattattataattatataatatgcattttcaattttaatagttcctgccaatttggcctccacagtggctgtgttaacacagttcttttcatatatgcaacatgaggggatggaggaatgttagagccctgtgcttaagagactcccatgcttctctcaaatagaaaaacaatttataatttttattgacttactgagtgttttttttccttctttttgtctctttgaaagggagcaaaattagggccacgaagatcaagttaatgggagtattttcatagggagaggaaggctgcaatgccaggaaagctgtgacccttgacttgttgcatgctggagtaattcggttgaagatagctttatgtatttattttgctttcagaataagcagtggaccatttattacaccaagttgtttgactttgaggacttacatggactcaggttcaaaggtatatgtggctgtgttttgaacacacatacacagggttttgctttctgactcaaagctgtccgctggccaggctcatggtggcagcaagggcactcactcatctgtctcccttcttgttgcctatggatggcacttgggtgagagcagtgggatggtcacaaggaggaggatggactgccgagagggaggctgggtggaccccagccaagaaggacgctggggtctcattattatgggagctagaaggcctggtttaggaaagaattcctgttctgatgaaagctcttcagtggactcttaggataaagtatcatcaaatggcttttacaagggccagtgtggaccctgcctacctcatcctcatagtctcatcactggtctgtcctgctccagctgttcatactctgtctctctggctcttggcccatgacaccccctcggttttgaacagtcctcattaacttctcattctctaggtctcctttggttcctttccctgatcactccttggcattggtacagacgaacagtcataaaccttgcccatattttaagcatgctgaaaaacaccatctctagtaaaacccaaattctccaaagctgcatgggaaactcccagaggggatcattcctgcgctgggagaaagaacttagggctgcgtgccacccagagggataaacctaacccactttagagggtaagcacccactatgctctctgcattacttgataagtctagtcctgtcttctggtggacatgataccctagcaccctcccagagaagaaagtggagatttctaaatgccaaccctgcaggagatcacaaacataatactgtaattttcatagtaagtttggtgcccttactatgtgccaggcactgtaccaagctccttacttgcctatcagtcatcccagctgcctgatgagctgtctcaggctagggaagccaaatggcttgcccaagctcacaccacttgcaacctatacttgcttagcctatctccaaaacctgtgtttccaatcagtctctcatatagaccaagggctacaactttttagacttgggaagattctacccattttgcgacctctccacatgagtctttggctccccactgttggggtccccgtcagtctgcttatctttggttttcttcctctccagacatgccttccctgctgcccccaaattttattactgtatagtcagttctgggatcctaacataaccaagccttacctcctaacccagtgccctttcaactctctcagtggttcccagacttttcaacactatggaattttttaaaattaatttttccctccaataagttctgtgtttggaacagttatccgacacaatttcatgtgttgagtgttgattaactttccattaaaaaacaaattaaaatataactagaactgctgatactagccagtcattattctgacacaatcagctaatatactaattaattatagccgaaagcaaggacggttggtgttttcataagcctgggaagttttctcatgggttcctgggtgattgcattgtcggatttgggttggcttactgatatgcctaaaatagctcctggcttctttggtatatcgctgtcctttgcccctcctgagaatctttagtttcatgccagcttagcatctcttctccctgtgggcaggtcccatgcatttactgccattgtcacttctccctgttacccacagtgctgccaccatgcctgggatagacagcaggtaactgatgtgtcctagttgaggtccctatcctttcagaggaggtgacatgggttcagatattttcctatgttcatgtctggcatccaggggtacacaaagtattgattctagctaaagggacttactaaatactgtttgacaggaggcccacaggtgtctatgtgggctgcagtggaactaagaggtctttttgttcagctgttaaaaaattagtgtttgtagcttcagaggggccccagagaacctttcctgacccatttagaggccatctgtgtggctaggatggctttgctgtcacagaagggacagtccacactacccaacactcaagtctgatttatgttcatgtaaatccgatcacctaatggtggcattcacggcttggagacaagaaactataagtgtttccaagcctgcagccacctggctttttgtgggggtggggaagggaaggaaagctgtacgatctggcctcagagagcccaaggtaaagttcagttagtggaaaaacagagccctagatgattgggcggggggtgggtactggggagtggagaggggaagtcctgagctgaccaagcctccaagagccattccggaactagagatcttaaatactacatggtaattatcccctctgcctctgcccatgagggtgtcaggcacagggccgcctggctgcctgcagagaagagctgtttcattcagaaacttcagagctcctgcaatgcctggattaggatgtggggatggtgagtttcgcaaccagggtcagatttcatgaagacttggtttcgtgacttgaggtgtttgactaaggtgtttgcatctcatgtatttaggaagggctcccttttgacttagactttatcatcatgaataagctccctgccttttcgatttggaaacatgatagctctagtgagctctgctactcccaagcttgggcaggttctttgcctcagtttcctcatctctaaaatggggggaaatatattatgtaccacgtggtaacttcattggcaattaagtgaaatacttcatggaatgtttagcactaaatattccttagtgttgaaaaggctgggaaccactgagacagttgaaagggcactgggttaggaggtaaggcttggttatgttaggatcccagaactgactatacggtaataaaatttgggggcagcagggaaggcatgtctggagaggaagaaaatcaaagataagcagactgaggggggccccaaaagtggggagccaaagactcaggtggagaggtcgcaaaatgggtagaatcttcccaagtctaaaaagttgtagcccttagtctatacaagagactgattcttggcacagaatagctcaataagaataagcatgagcttttagtagtagtgttgttatagagcagagctgatattctcacttcactttcggtgaggaaaatggcgctctgtggtgtgatgtgatgttttccagggtcatatagagagagctgagtttcaattcaaaatcgtggtttgatccccccgcctccaaatctaatgtgttccattttgtcacagtgcttcccacagggcagagaaagaaacaacaaagttcctactctattttcacaactcttcacattttagagtcttaagtccatttgatctcatttgatgacaacttcgcaacgaggaaagcaggatggtgattggggggtcggtcatagttcctagttagtggatgtcagtattgagaatggcggggttctgtggcttagccatatagccaatacatggaatgggattggaacccatgtcttctgagggcaagcccaacacttgtcaaggatctggtgctgcccttccctctttagacagctcccattgataagcagaggtagaagtcactagggtagccaaagagagggccctagaaatggaatggtgacaatgaacttggctgaagagtcagcaaccgctcccctatccactgccagggctaggaggtgcagtgtggcatggaggaggagcactggctggagttaggaggcctaaggtctagtcctagttcatcatctgactctggagtccccttggtgatactgacctccctgggtttggtctcttatctgtaaaacagcaggatattggctctatgtggtgtgtatttcactgaatgcctactatggtcaagtttttctggctctaagttcccttggaaagggctctctactttagctgaataactcagcacctaaatctgtcaaccacacccttcagtaggtaactttgttagaaatatggtctattaaggtaagagccaggatttctgtggttgcaaaagtggatgcgggctctgaacaaaacctctagtgagctgagatactttatcagatgacatatttgaccaccaaacttctgttggagcagggctgatttgccaaacagacagcaaccttgcagacttagtcgatggctagaattaagactcaaggtcacttcagggcctgtcactgattgtgggagggcttggtaaaaattgaacctcattaacaccactgaagaagctgatagacaagaaatgggattaagactcaatactcatcaaaataaggctttccttatccacagcctacctgagcagtgcctcactctggaaaatgtggttcatggctcggctcaaacattttctgttgctgagaggacttctctcatggaagtctggctcagatgaacacatgtgtgatctgatggaacctttgtttaagtgaatgaggagggtatttggaagacttagatcaaacgtgtgccccattgggcagtcactatctgctcccctgacagggagaaaccccagtgacaggatagaaagctccaaagatcctgaggaagtttggaaggtcaaacttcaccactgcaaggactgagagatccaagaatctcagaatccaggttggtctccagggtgcagttctgaacaaatgagtgcagtggataaaaagcttatacttaaggtgggaaggtgggtgtgggttccagttccttctttggctgattctcttttggcctggatttcctcacttgtcatccatgccatgtcacaaacccagtgcctacagggaccaggcacagaagctggatatttgagtatcagacatattggaatattactcactcctaccaaatatgtttatggttccccattctcttggtttccattttggagagctaaacaggtactaaaaatgatttctttattataagacaagcaataaaacagtgggcaagtgtgatgataaacagcatctgagctttggctttggagttggggagacaatagagagtggcagtaactgtggtgaaccgtacagtccaggtcccttctggaggggacagctgctgtccagctccagcctatcaggatgtgagtctagtgatgccagatttccagtctcttaggacaagcaagaaatccaaatttttaatgtaacatcttctgaaaagatacacacacacacacacacacacacacacacacacacacacacacacacacgtggaccaaacaaaacatgtccatgggccagattcagccttgtgggtcaccagttttgtgatctggaatccattttatttctagaatctcctttcaattctcggatctctgagtgagtaacacccaatttttttttttttggcaaaatgtgtcctgcatttcccacactttctgagctggagcacaggttctggagttagaccacttggctcaaaccttggcctcgttcatggctagttgcctgtccctggacaagttaattccctggtctcatttttcctatctgtaaaatggagtatgcaataatagtactcttaacctcataggttgtggaagaattcacagacacaatggaaataaaaggcctggctcattgcctggcatgtagtaaggacctgataaatgtcagccatcatattattactacatggtattactgcctccccttagatgggagccaagtcttgctcaccagctcattgcctgatgttagtaggcattcaataaaagtatcatgaatgaataagaacatttgagaaagacagcattccagcctttccaggcaatactcgtgtgtgtgtgtgtgtgtgtgtgtgtgtgtgtgtgagagagagagagagagagagagagaaagagaaagaaagaaaagaaagaaagaaagaaagaaagaaaacaaagaaaggaaagaaagaaaaaaaaagaaagaaagaaggaaagaaagaaagagggagggagggagagagggagagagggaaggaaggaaggagagagagagagagacagaaagaaagaaagaaagaaagagaaagaaagagagaaagaaagaaagaaagaaagagattggtttgaaacattgggagctgagcttaatgagaaaaggccattcctaactgctaagctaccgtattaaacagtggcaagtaccttggaaaataaaacagaaaccactgcccatctttttctaacggagaaagacaagagatggcttgaccagagtggagatttagaacttcaggtgctgataaatatggtaacatcatggggtgctttggcagctggatagattttatttattcagggctcctttaagccagaggagattcctggaggctgctaaaatagaatgctccacctggatagttaacatctggattttattttgtttcaaaaagttaattacaaatagttcgaattccttctggtatccctctgagaagagtttcttactgggtggctcacaagcggggagacagaaagggaaaaaaactagattgatattgctcaggagaaacaggattgtggctacacgtgagccatgtatgcaattttgaattttcccatagtcatgtttaaaaaaacgaggaaaaagtgaaattaattttaatactaaacccaatatgtataaaatatgaccatttcaatatgtaatcaattttacacttattaataagatcttaatatttttaaaattaagtttttgacatccattatgtattttacactcatagcatatctcagtttggactagttgcgtttcagctacctgtggttagtggccgccatgttaatactacagcacaggtcaagataacatttgcaaaggcaaggcatcttcccctccccatttctagtttcatgaactgtgcacagggatatggggctgttcgaggtacttttgggctgaccaaggctcagaggctactgacagctttgctgcaagtaacttctaggccttgtgggtcccagtgcagggaacccatgtgcggtgacactggagaagccatctgatccaggtctctcacttgacagatggggaaactgaggtccaaagaggtacagcagcttggtttaagagatagagatggaactggaacaaaaataataaccatttgataatattttaacatttattgatttgtttttatatgccaagaccttttaaagcattatctcctttaaactctcataaccactcattgaggtaggcactcctatttctactttgcagatgaaaaaaattgggacttaagaggaattaaatatgaaagcagctactatttgttgacagctattttaagatctttatatacatatatacatgtaataaattctattctttactataaacatacatgtcagaaattattagtgttatcatccttgtcctcctcattccactttgcagatgaaaatactgaagctgagagagactaggtaacttacctagtatgtacctacatagtgaagccagatttgagccggacctcctgactccagagtccgagcaatctcaccaattctgcccacggtcaccccactgcatgatggcagagctagtatttgagcaggtgtgtctgttctgtggtctgtggtcttcaccgccccactagacagcctggatttttctgctcttgagtctcaacactttctgccttactgtgccactagtaaggaacagaacagggaggtttttgaccccagcactgattgaagggcccaggcaaagcaggctcgtctcctctggcttggctggttcccaggctgccctaacccatgaagccagattcttggccaagttaagcagggtgggaagaacacttgtccattccgccttcccagttgggcgaggtcagtgtaccaggttggaaagtggtatgtgtctaattgcaggggcgggggtaggggggaggccagaggattaacactctttaaatagacatcagaaaactaagaatagccttgctgcctggtaattgatgggcattcctgactacgggccacacactcagtaggtgctcgataaacatgggtgaaatacaggaataaacaaatactgaaaatgggtcattgggtgagcacttagccagtaaaaatctgtgctttgtataaaaagaactttggactgaggttatatgagtcttcctgcaggctggagacctctgttacctttacttctctacttttgttgtcttgagaccagcttttttatttttggtgaggagaacagcaggcagttcaaatgtcagggaaagacaagttcagcttgctttttccttatttctgtcttgttacctgctatcctgccaggttagaaagatggaatcactcccttttgccctatcatcaagacttcagtgttccctggagcactctaaatttgccatcagacttggatcatcctctaataccaagctcctgggtccttcctgaaggctgcctccttgtcttgctgagaagaattaaggtcgcttccctgggaggaattcagcagcacctcttgtaagtcatcaggtgtgctgtaaggatggggcaggcaacatttctttgtactgtgggaaggcctaaatcagtgtttctcaaggtgtgatccttgcaccaccaatcttaagaaatgttctttggagccgggcacagcggctcacgcatataaccccaccttgggaggctgaggcgagaggatcgcttgagcccaggaattgaagaccagtctgggtcacatagtaagattccctgtctctactaatttaaaaaaaaaaaaaagaaaaggtggttgggcctgtagtcccagttactcttgaggcttaggtgggagaatcgcttgagtccacgaggttgaggctgcagtgagccatgattgtaccactgcactccagccagggtgacagagcaagactctatctcaaaaaaaaaaaaatgttatttgggagagctgtttattgtattcccctcttggagagacatgtggctattagcatagtaaaagctctgagaagtcctgctgcatggtgacctgtttagctctgtttaatccagtgttctctgaacatatctagccaaggaactaattttcccaagaagcacctacaaatgcagttggtgagacactgcccagatgaggattctgaaaaccccttttgcccacttgcctgccattgtgattgctgagtagggaagaagaaattaggaagtatcatctgcattacacagggaagctgctctcctagggttgccaaacagaaatggctgtagtggtgccagtgggtgctttgtagggaccagaagaaaaaggaggaagggaaggctgaccttcaaggtcacacatttgccagatttaaagttccttcctgtggtcatgacttgttttataatcttgcttggctcagttctgggcacacatcagatttttaaatcctaggatcttgtttataccgttaaggacatgattgaaggacattgtggtgagtgtgaaggtgagatgtttctgattgaaggtccatggggcaggcaccctgcgagcaggtaatgaacagtaggggacataccggtgcaaccccaccctggtcccctggtcgtctgggccagatctctcccctctctgttctatacttctcttacatcaccgtcctacctaatcattttaccgataggagcacctttgggattctgattaaagctatgcatacaaatttcaagagcttcagaaattctcctaaaagctatcttggatcattagaacacttgccctagagtatcactgagtcaataatggtgttgaaactaaacagcaacaaaatccccccaaaaaggtaacctaacttagtctgaaattgtctgaaaattaatggcactgccagttcagtggctgctcagagcgttttggtgaagaaattggctgatggatattttgcagtagtctacaggatttgacgtgggatgccatctttatggacatggctctgctgggcaaagcaaggacgggcacatccagcctatgcggtccatcaggggcactcacatttagaatgggggagtcttagttagcccaggggctgggggcagcatggtagtgtagaaaaaggggccagtgcctccagaaaatgggaccccaggcctggctctgctccttctgctgtgtgattctggttgagtggccttccctttgagtcctctggatgaagttaaggagaagtcttgggttctcaagtagtcactattcagactctcgctttcagagtatttaaaggaggaaaggaaacagaaggatagggctggtggacttaaaaggccgtgtgtttgccgccaccccatttgctcccagggctgggtgtttgtctcccctccggcgctgggcctcctgcttggcctccagctcttgcaccattaactgcagtcagaaaagctgatgtcactgtggccggcctagggggaaagtctcaggataaaactgcttccacctggatctggagaaggggaagtgactggcaagagattcgcaggtagggctcagagaccaggaggaatccagtctgggtaagaattccctgtcatggggctctgaagccacgggccaggcaggtagtggatttcaagccagccagcggggtcacttggcccctgcagctactcctcgccccctcctgcataatttcctatttcctgcctcctcctcctctgacacagttataaataacctcgaggctggcctctgcgcttaagtataggtgagccagaggaaagtggaggggatcaaggtggagctggatctgccacttggccagggggtcacagggtttcagattgctcaggggaattttgttttcttgttttttccactagggagtgaggtagtgaaagaggaaataagctgtgttggcatggggaggcttggccttgcaggccggtgctgggtttcacccgcaaggagctgcctctctgctcactgcagatccccaggaccaaaggtctggaaagaggcttagtgagaaggcatctcaggacacaaagaggacacgatgccttgctggtgaggtcctgcggtctccttctcgaggcccagcccggccccatattggaggccaaacatgtagaagggtgtatctcattttttacctttttttctcaaccaccagccaacgatgggtatgtgatttctaaggatgtccattgactataaaggtcccattaatacatatgctatggacagattctctccttgaacacaggtttatggagcacctactatattccaggtgctgggcagagtgctaaggtcacaaaaatgaatcagctgtggcctctacagcctgttcccctcttggcatagatctgcccttccccctccacagtctggacaatcaaggacctggagtaagcacactctaggggccgcgtctcccagcatatcttttgttttcgaaagttcaaaaaacagaagaggaggattctgaaacagcaaacttgctgggtcatccatagagtatattaactggctatcttgctatctgtccataacttgctacctgtccatagtgtatattaacttcctgggagcccactcactgcctgacttcctgttctgcgcatgggcccaagggaagttctcgcaaccatagttttctgtgatatccatcctaccacatggcttcctgggaaacccattagcttttttgtttgttttagagcccaagggaatcagggccttgaggggattttttggtgtggggggtggtgcaagcttctaacactgagagtgggtgcttttctgattcctatgaaggtggagtgtaggtgtcgttcctggctcagcagagtcagccctctcatcctattcaggccgtctctgaggctggctcctgtgcccaagcccttcctcactccctcagggcatgatcacagggcatttccttagcattcctcctttctcccctgtgtgtgtgtgtgtgtgtgcgtgcgcgtgtgtgtgtgtgtgtgtggtgtgtgtggtgtgtgttctactccgtgtgtgtgtcatcctctgctcatccacccattccactgcgtgtgtgtgtgtgtgtgtgtgtgtggtgtgttctactccgtgtgtgtgtcatcctcctctgctcatccacccattccactgcagcacctagcatcacctaggggcctggaaaacctgcacctgaaagccgtaactccccggcacctggctggttgacttcttcccccttaaccccatttactttgaggatggaggtagtctttagggtcaggctgagatttgtcctgacccatgcttagttggcacatcttgcttctgcaacatgcttgcttagggttgggcaggggcccggagaaaacaagtcgtggcatcaccaggacctgattacccccaggcaccaaggagcacctgggaccaaggggaggtttggggcttgggatatgttttagggtgaaggatcacagaagcttactcatacctatttgaaagccaagtcaacagatgtgggttcttggaaggagaaaaggaggttaactgcttacttattagattagaagtgatgtatgaatgataaagagcagagtttgccagatattgctaattaattctctcactgcttattttatggatgataaagggtagggagagacatgttaattggcttcaaggtctctgagccaagcatgaccaatccgagaaacccaggtggcttcatgctctttcaatatgatctcatccctgcactagagaatttatatttttgagcataaagaatacccaccggtgcaatctcccaggctcttctgaagggtttggagagacagtggaggatgtcaaaagagatgaacttagagtcaaaaaaagcagagatggaatcccgtctctgccttttaccactggagttagttgactaaaatgtaaactctgagccttggttttcccaattgcaaaatgggaaagaccccatttataatgcaggtgggtgagagatgccagcagtgacagggactttcagtaaaggctgagctgaagctgaatttgaaaagcacattctttacgttccattgaagatctgcacttgctcttctgctaaccgctaaggtgtcatcagtgctgtgctattaaaatcagaagtcaaagaaggtgggtgtggccctcatagccagagttgatagaaatggatttattaatataatggatggtccatagaaaggtgaatgacctggttaacagacagggatggagtggagacctgtctgccctggtcttcaggctggttctgaaatcacagaattaagatgatctcagctgaggggcaaggcaaatcggatggaagagcggaggcccagagaagcgaagccctttcccaatatctcacagcaggtggggagtgggggaaagcagcttccagggggtggattcctgaaccaggtatttgtcactgtcccacgtagctcctcttgtcaccatatgtcccactcagtggagggatacttcctgcaagacaaagagggcctcatggttcccccgtcactcactgccttccactccctgcttctgattattctgtaagaagttgaggccgagcgcagtggctcacgcctgtaatctcagcactttgggaggccgaggcaggcggatcacctgaggtcgggagttcgagaccagcctgaccaacatggagaaaccccatctctactaaaaatacaaaattagccgggcgtggtggcgcatgcctgtaatcccagctactcgggaggctgaggcaggagaattgcttgaacctgggaggcagaggttgcaatgagccgagatcgcaccattgcactccagcctgggcaacaagagcaaaactccatctcaaaaaaaaaaaaaaaaaaagaagttggagctctgtctgtctgtcctttccccaactccccatctccgaggctggctcctgtgcccaaagtcttcctcgctgtctctgggtatgttcacagggtatgatcacatttcccctgcatgccctgcgtgggatgtgctccatgtgctgatgcctctggggatttccagatgatgtccctggacttggcagagcagtgtggggaatctgggacttgcacttcctatcctcatggagtctggtctctcaccttcacaggccactaagaggaaaggcaactggtgtgacgtctggggagggaagtatgttcctgtgcatcgaaagcctcaaacatgtgcatacactttaactagcaatcttacttctagaaatttagtcctaagaaataactaggcaatggagtccattgctacattgtttatccccaaattaatctaaatgtctattgcaaatagactgcttagattatggtgcgttcatacagtgaagatctgcacttcctcttctgctaaccgctaaggtgtcatcagtgctgtgctattaaaatcagaagtcaaaggaggtgggtgtggccctcatagccagagttgatagaaatggatttattaatataatggatggtccaaagaaaggtgaatgaaagagtcataaaagatgttgaggtagttctctattgatgccagaatagccctatggtgcacttttgagtaacagaagccaatttgttaaaaacaacaacaacaacaacaacaaaaaaaaaacagagagagagagatgaatgtgcatccagatgcttagagaagagtctgaatgtctgtatactaaatatcaacactagttactctgcgctgtgggattttggatgattttaatttgatccagtgttttctggaaaataaaatttcactacattgacacatcatttgataatcagataaaagaacaatggtgggaaagcaaggactcaagtgacccttgcttttgggtctagagcatcatgtaggaagccagcacagcccatccctttcctaggcgccaccttctggctcctggtgggacttgtaagtcccgtggtcagttacctgattgctcttacggacctgacgctggaaatcctctctctccaaggtccctgcaggagatgggacctgccacagagaatgccgcaagggatgtttctgttgggagctgtgagtggggtggatgtcctctgcctctcttaaatagatgagctagatttgaacctggggctggccaaagggagtctcctctcagaaaccaggatgcagtgggccgtctgtgtcccagccccaaagcagccagggtccagtggattagcacagagccgaccaggcctggagggtggtggtctgggattgggtgagcagccaccagcaggaatagcaattggagggaaggagaagcattgccaagagcaacttagggggccgtgagtgcaggtctctggacagacagcatggtaactggctgaggcaggaagaagcttggtgggctcccatggtgctaataataggccgtgtaggagcaggggaggcagctccagacttggagtgaaaagacgtggggtgcagtcagaatgaactccccagccatccatgtggtctcaggcaagtcactctgcctccagagccccatgtccactcctataagatggtacatccccacagtgccctgccacaggtgattataggtgaaggtcttttgacacctatatgtctaagggtcatggagtgacatcttatgaagtcagcacatagaaagtcaaaaaacccttacattcctgtaaaatacagtgcaggccaggcgcggtgactcacgcctgtaatcccagcattttgggaggccaagggtggcggatcatgaggtcaggagatcgagaccatcctggctaacacggtgaaaccccatctctactaaaaatacaaaaaattaaccaggtgtggtggcgcacatctgaagtcccagctacttgggaggctgaggcaggataatcacttaaacttgggaggtggaggttgcagtgagacgacacctcgccactgcactccagcctgggcgacagagcaagactccatctcaaaaaaaaaaaaaaatacagtgccatctctccataactccacctgagccagcagttccatcagtgttgtgacagattactattttttttttgttgtcaagtaccctcaggttgagcagctgagatgcttttagggagtgagacaatctcaggatctgtctttaaaccccgtagtcatatagggactggcaccaccagagacaacagcagatccctgtctggagctcactgaagaatcaggggtgggaggaattgcccttttaaaatggagtgtatatatgtatatattttttgcataattaaataatatatatatgtcattgaactcaggctggttagaggcatgcatgtatgatataaattctctgtatacaaataaaaggaagttacttgtattcgttgaatgggttgttatgatgactcccttcataggaaacatttggatccatttcctctgctttcgatgttgttctttcgcttctgaaccagtgtttgaggcagatgtctttgatactgagtaaagacatggcagtttgcattcactctctgaccaaaagagatgctccctactcttgcagaatactgattgcccatgacaaccagagtacttttataagaaaaggagcacacagaaggcagaaagggaccttgtttggggaggcggctttgagcagtgactttatgacataaacgattaggctcttcctggccccgcctgtcttgggatatctactcagaccctggaactttgaaatcgcaggctgggtccaatgagcgcagaaaagggacaggactcaggcagataggatttctttcgggtttggtaaacagctggcctctaggggtagggacaggggcagtgggtgggaggacttgggggagggatgggtgagctcgtgggaactgagaaactgtgtctagggcttccttagttatactgaatgctgcatgtagaggtctgcagggtggccagctgatggctggcggaagatctgctgacttggattcagttactactaaaatggcaggtttagaaagaggagagaacttctagatccagaggaaataatcaggtaagtatgctaagatgtgtgtatgtgttagccaggcacggtggctcacgcctgtaatcccagcactttgtgaggctgaggcaggtggatcaccaggtcaggagctcaagaccagtctggccaacatggtgaaaccccgtctttactaaaaatacaaaaattagctgggtgtggtggcgggcgcctgtaatcccagctactcgggaagctgaggcagagaatcacttgaacccgcaaggcagaggttgcagtgagccgagatcatgccactgcactccagcctgggcgacagagcgagtttccatctcaaaaaaaaaaaaaaaaaaaaaaaaaaaaaaaaaaaaaaaagatgtgtgtatgtgtgtatgcttatatatataatacatatttatttgtacatatgtgcatgtacagatataaacacacaaggatgtttatcatagagttgtttataaaagcatccaactaacatttctgtatctatgcaattgaaaacaacatagccattcaaagggatgaggcagagctatatgaactgatatattgggattgaaataaaccagatcaccaagcacattttggatgattctattagcaggggacgtatccacaagtttatagtagcatagggaaaagtcttgaaggtaatataaatataaagcatagttataactggacagtgggagtttaggtcatttacacaattattttataggtttttgtttgtttgttgacttctttttttcccaacctttctttagtgaagttgtattacttaagttaaaaaggaaataatgagcctggtgtggtggctcacgcctgtaattccagcactttgggaagccgaggcaggagcatcacttgaggtcaggagtttgagaccaggctggtcaacatggtgaaactccatctctactaaaaatacaaaaaattagctgggtgtggtggtgacacctataatcccagccattcaggaggctgaggcaggagaatcgcttgaacccgggaggcggaggttgcagtgagctgagattgtgtcactgcactatagcttgggagacagagcaaactccgtctcaaaaataaataaataaataaataaacaaaatttaaaaaggtaataatgtaagaaaataaagagcatggagaaagtagaaaaccagataacctcggtcctattttgttaaattttgggaaatttcagtatctgcattgtacagatgacaggcagaatcttgagaagttaacactttaaaagaaagaaagaaaaaaactagatattcactatgtgtcatcttgttgactattctcttctctgaacttcctggcatcttagttagcctatttgagctggaataaaatgtactacgtgtcttcagattctgcaaacatttaccaggcaccagggcgtccactatccagtcccaagcctgccactcaggagttcatgggggagtgagtgcatgtggcaggcattaggcagggtttttgcattctgctctcccacttgatccctgtgacaaccctaggagcctgctgccactgatcttcttattccacttgagggaacctagaggcagagacaggatttgaatccaagcctccagctccaaaccccagctgaaggaagcaagctggaacccaagatgctttcaatccctgctgctctgagcactgagatttgttcactggaatgctggagttttgctgatcattgacctcgcaggggcccactctgaagttaaaaatccccgagtgaataaatctccagcctctcctgctgtttccttcccagttctgaaagtgagggcaggagagatgagctttggccaggaattcagcgagtgactttgcgtggagtgtcagcttctccacattgctgggtgttagcttacccctgtctggcaccagcagcaaaaacagagccaggcgtggcctatagcaaagctcccagtttaaatatgtgaattcatttgggcctggacagctgcatagctcaggctgggcagaatctgccaccctaccccgtttccttgaaatctatacaggaacacagttccaaataccctggtgccagtccctgcaagctcctacttgtacaaatggattttaaaacatgtgatgatatctacctcctcccgtacctctgggcttttctaggtgtcagcatgaatctcatgtgagctttacaatgaccccagagtgggtgggcaagggagaggtggttatgactatcatgaactcccttgcttttacaagccactcccctacaatcctttctccaacaagtagacagtgaactttaaaaaatgtcagtcacatctctgccaatgccctgctcaaagccctccagtggcttcttaattcctcaagaagctctagaagtttctacgggatctggcctctgtctcccttggccttgctgttgccacatacttctagctattcctcaaatgctccaggctccaagtttgtcactgtctcttttgaacttgctgtcctctcttccaggaacacctcatcccccagatactcactggctggccccttctcatcatggaggtctcaactcaaatgtcaccttcgtagagaggccttccttgcctcccttcccctcctaccagcctccttgtctattcccctttgcctcctagcacctgccatcatattgggtatttgtcttattgtttggcctgattcctcctccgttacttaggcaccaggagagtagagaccttgttggtcttgttcaccatctagaagatacttgaaactctaacatttgttaaatgcaggaaagaatgcccttttgacagctaggaaattgaggctgagacaagtgaagtgtcttgccctggtttcccagctagtgagtgtctgtgctggattcaaacttagctcttatgctccagccttcaagtgggggaaactcaagagggcaagttcttacggggccacttaggagcagacagcttcttaggacaacattcttttatgttgatgtgaagtagcaaatctttcagagatacaggcctctaaaaaattctgccatctgccggctgctgtgttagagccagcctcagaaaaaggtcagagatccaatccctggctgggtgctgtgcacccaggaaagaaggagcagaattgaaataagtcttttccactcttctagatgagccttctaggccacaggcagggcatacccatgcatagactttaagggcctttatttggtctgtttgcttcccagttggggaaacaggcccagggacaggaagtgacctgcctgatgctacctcatgagttagtggtccaggcagttagaaccaaggtttcccaatccagcgggagttcttacctacccactatagacttcttggccggttctgggagactgagctctttccttccctgtgtttgcctcatcagcacgctggactgagcgttcccagattcagtgctggagccagcggtggggaggggagtaggggctgaagagtatatcagccaagcttgggggagacagtcacataaggaaattcacactcttcctctctcattagggggccccacaatgaggaggggaaagacaaaaaacaaggatcttgggtacattggtccttacctccccactgccccaggagcggtcttgagggttggaggagactaccagcctcctccctatagcggacttgaacttggcacatggaaccagctgaaactggcaccatttctaccctcagagggtaccgctgaagaagacgggcagagatgaaagaggaactgcttaattcagctcggcacttcttagcagctcccccatcccattgccggctttagtcccaggccagagacccatgaggtgcgttgaacattactgataccctctttgatctaaaccctcctttcgtgatcacgcctggtggctcaaagaattgctcccccagcttactgttcctgttggtgctgaaagaatgctcgtaattgttaccaaacagtggacggagcaaggcaacatgtcccctttgcccagctggctcccagttggcacttcattatggcaaagacagagggggtggggtccccgggccttcggcatttcatttgcacccacatgtaggctcacttcttggcctgggaattgatcggtgccagatgctccatctagccagcatccccaccgcagcagggctgcccgcctcctgtttcgtgaaaaacggcccggattttcatcagaccttaattggcctgggtctggccttcattctaccccagcctcttcacagactgctggccactggctgttccctcctccagccaggacaatgccggtccccgggcactgaccctggcccaggcaggcctgccaactccatagctctcatttctcactctgcacatcagtgctggcttcccacacccacagctcctccagaaggaaggtttgtcagcgggcttcaccatgcactctgacgtaccacttttggcccaaccaaactacaccccacccttgggtagaatgggaccaagatgcgaccctgacagacttaaatgagaaatgagcattttccagtgacgcctcctcttcctgcctcttgctgggcctctctctgcattgctctggggtgttcactgcacttggactgataccagtcaatgtccctcgcttcaacctgacctgaaactgaaatgctccaaacaagagtaagtggggcagccgacatttcaggaggaggaaggttggcagccaggctgctgtgagcttgcacggcccatatgggtcccagctagtactttgcattttcttttctctcttcttggaaccccttcgtcctttttcccgctgccctctagcctcttcactgtcttgggaaagggggcctctcacaaaacagtagtcaccgctgctgttcactgagtggttactttgcaccaggcactgtgctaagtacctcaaggggagtatctcccttaatgcctgcaacatcctatgagccttgtatgattgcatctcccttttcaagctgaaaagaagttacatgctttgcccgacagtctatagctaggaggagctggagctgagattcaaccccaggttctctggtgcccaagtgctcatgtctttgccctgtgtgcccctctttcacagaaacagagcttcagccaaatcctggaacggaagctcttgggaagctgcctgtgacctttcttattgtgtcccctcagcacaggtcatgcacaggcagctgggaatagatatgcgagttaaaggaattctcgttggaaaacaccagagggatccacagggccacccccccgcccccgcaataccactgtgtgtctgtccctgcagggccctggaatcccacagttgtttcctgtacccaggcctggggagccagccagtcacatggaccgtgagtgtatccgcctcacgcttctctgtggcccctggcttctcccagtggattccgcaaggtgtttcctgcaaatcctgctgatggtcttcgctggcacgtagcaaaatccacccagaacaccgcgatctgctggcctcagcctggatggggttttgtttttgtttagcttttaaaaaaatgtgtgtttttttttccccaaccaggggcacaggggtgggggaagaggagaaacatgaaggtaaaaatattgacagagtgaaaagtattgaatattccttctatttcaaaaatagcagcttccatggctgggatgcaggctggctaagttcaggttgggctgaggttgaagttgagatcaaggtggcagcgtgacccttatgcctcaagcatgtccttcaggagggtgtgggagcctgaggcagaagagagctccttcctgttttaaaaacacctttttctgagactctcaaagaatgtttgaaatcagccatccaaggtgctctgccatttttaagagggaggacggggctggatggtgtccctgggaattgaagggacccagagaagaggtgaattgtttaaagttaactcagagcattagagtgggctgatatcctctgaagagtctacttgtctgtgagagctgtttcagctacttcaaagccagatgatcagggcagcggggctggattttcatcttcatggctgtgcacatctccacttgatatgtgggggtcggagttggggggcagtaaagcctggtccccatggagatgctatcctggaagcatttttattaccaaggactagcatataattggaagattgaaggcagaagcccttatcttctcggcattctttagaattcttctgtatgtagatttcagaacacacagagccagagcaaaagaccttacttggcattaacaccaggatccacctgcccctcccttcctggcattaatgtccagtgctcccctaatgcactttaagctgtgaagttatcccaggtttatttacactgtaactaatttactcttggctggactgtcagcctggaaaataggatgtcactgcaccccccccaacctccaccaaaaaaagacagtggctaatgaagaaaacagattgttgaagggcactaaaattgaggcaaggagctgaataatgtgccctcctcaggggcaggcagggcaggcgtggcaggctgtcggcattgttacagatcagcaatgtcccactagttagcaaatgggcccctctcagtttgaatgtgcagctgatggaccaggtggggtgattaggggccaactccgtacttgtttctgtccccagttttgttaagtgcagatcacccagacagatcccaggctgagaaagagactgaagacaaagctagaagaggcagctgaagcatcctaatgtcttaactcaagtttgacttttcagaaatgtgattttagaacatagcaaacaggaagcacgtgacaacttggaccactacaacgaagagaaagtggaacccaggggaaatgcatgagttagaaatataaagtgatgggactcttagattctagggttaattgggacactagaatatgtccagtccaacgtgttcattttgtacaataaaaaacaagggctccaggaggaaatgatttgtcaaactcacatagaaaatgaatggaaaaaaacagaaagagtatctagcttccaattcctggcccagggctcttcttgctattcaatactttctacgtaataagcctgggttttttttttttttcaaaaaaattattatacttggccacccagatgagtacagttatttagtagagtacgtagagttattcactaaatcacatcaaagttgggagacagagtctggtttgaaaaccctcgagtattttattttattttattttattttattgtgataatacttaacatgagatatactcgcccctctctttttctgagacagagtctcactctgtcgttcagctggagtgcagtggcatgatactggcttcctgcagcctcaacttcctaggctcaagtgatccgtttccctcagcctcccaagtagctgggactacaggtacgtactaccattcccagctaatttttttttcgtggttttcgtagagacagggttttaccttgttgcccaggctggtctcgcactcctgagctcaaggaattcacctgcctcgacctcccgaagtcctgggattacaggcgtgagccaccgcgcccagcaagatctaccttcttaacacattttttaacactagaagtacttaaatagatgatggtgaagtctcaagctgtcctaccagcagtaaaaagattccaagtggggaaggtgaactctcaaccttgtatactgatcggtggctcctgggaaatttgcatttatcccctaacaaagccattaagagagtcattggcccccagcaagactgagatggtcgaaggacatgggaccatgtcataagcagggagagaccatcctaatctatgaaaatatttatcctggagatgatttgggaaacatgacccttcttttcaaatatcttgtttttttgtaagcccaagatgtcacctaggtgggagaaagccacagggaagcagtccaaaggagaatttttttatagtcaaaaaaaatggcttgacatggaacaggctgacctaggtcagagatggttgcacactgggcagtttaaccttgggatgggactgtagaagaaattcaaaggagcttacactgagtgaccctgaaggtcccacccaacctaaagtctgtggcctgtgaaatgtgcccatgccactgtgccgtagtttaacatgtccttctggaaggcaggtaggacccagagatgagaagtaggggctcccaattcaggctgcctggactggcatgctatgtccaccacttccgcattagatgatctggggagagtcacttcttctttacaggcctcgatttctaaaagatgggctaatgacaacacttactttatagggccctagtgaggctcaaatgggaaaatccacggaaagcatttagcactgatcatgcatggaaagtgcctgatagctgatggcacctattgtaactaataatagtattagaattagtattgtaatcattgacaataggatttttataattagggaaagtggggaactacccacatgaccatcctcctgctttctgtgtcagtgtttgaccaaatgtgttcatccctggtactctcattgcttatcctccgagagcactggcatataatggaaaatgtattccaatttgttctgttattccagccaggaacatctaggaacaggggttggaggtgtgcttcagggactacctgagcccagcttttttttttttgagatggagtctcattcttcttgcccaggctggagtgcagtggcacgatctcggctcactgcagcctccgcctccaaggttcaagccattctcctgcctcagcctcccaagtagttgggattacaggtgccctccaccacatctggctaatttatttttttttttgtatttttagtagaaacggggttccaccgtgttggccaggctggtctcaaactcctgacctcaggtgatcagcctgccttggcctcccaaagtgctgggattacaggcatgagccactgcacccggccaagcccaccttttgataggagcctcccatgggcaggcagagtaagaagtgtcacatgcagccactggtcacttaggcaaaaccctgccagctttcagatgtgcagtggaggtggcagggggaggtggctggtgctgtgtatgttttgcagatactctgtggtgtggcaattgctctagaggactctagtgtccagaagcaggcatgtgcagtttatcattacagccctccttcaaagaggacagctggccctgtgctttgcagggagaggtgcactccgggtggcccataaacccagaaaatatgattcctatctggtacagggtaccatcctggcacctggagaggggtctgcatgagacccagaaatgactggatccacaacagacctagtttgtggaacagtcctaaagaatcctccattcaagcttatatctgtcacccagggaactggacattcccttcagtcagaatgaactagtggcctccccttctcttcagccagggtctttgcagtcctcagccatgtgacctccgacctgtcagtcttggtctgattgctgtacccttgtttgtgctgtttccattgcctggaccatccttcttttctttccatgatcaaaaccctatacattcttctgagtcagttcatgcagcggaattggcattggaatgttgcagctaattgcacatactgggtgacagagtgcacagtagagaaaggtagggtgatacactcttcttaggaagcaatcaataagggccaagatggaaaagatgtcttatttcacccactgagcacctactatgttccagacactgtgagatgttgcggttagatacaattgtgagcaaagcaagatgtaattccggcagaatttagtgagtgtatgggggcagggaagaaagaggatgagacatgattcaaatgaatctacgaacatatagttacatacacactagggcccctgagaatacaaaacaggggttctgttctagtcttatgcttgcaggaggtggttggggatggctttatgtgaggaagtgttttttgattttaaatgtgaagtatgagtggcagttgatgggtaatggggagcagaagagggtctcatgcagatagaatggtatgtgcaaaggccccaaggctttgcaactgagagatttagaccagggctgccgatcagatgtctaaaaaagtatacttgttcgccccttgccatactctttggtccaaagggctgagctccctgtcttcaaaccagggggcttcaggtcagttactggacttctctcttcctgccctttgtctgcaagccaaggtaccctcaatctggcattgagagccctggggcccacccagcttgtaagtggagatttgaatccagacttcaccattggatgagattcttagacattacaagagttatggagagttaactccacctcaaagttctcaccatctgtaacttatacaagcccttctctcataattcagtcttgggaattttccctatctccgcatttccaatgcatttgacttggtggggtgtttcagatttgttaaatatttagtagtagaaagaagatgagctttgctgctgggcatatttggattcctagctgtgtgacttctgacaagtttcttaactatcctgagacttgttttcttcctatactcagtggaaataaagctacacattttggggaatggttttaagagtaagatgtactgtttgtaaagtgtgtctgtcttgttcacttttctgtttctgccacctgacacaatgcctggcacatagtaagtgctcagtgaatatttactgaatgaataagaggtttaggcaccatgattgcacagacacgatgttcatagagtagttggtcttctccttctttatcaatgactccatctccctgtcacacttcaaggccagggcaggtggttcagaaataccagaggttggctttatagttctgccattacccactttgaccaaagagggcagcagttagcattctttacttatttattttatttaaaatgaaggtttccttaaaaggatttggatcttctctttaatcattcctccgcaccttcagtgctattgattcctgataatggtcttagggcttgaagacctatgtatgggctcgtttttctcgtacctgttcctacctgagtgcccactatgtgagtgatgtggttgtgagctggaagggaggtgctgagtgagtaggggaacacccgctgcagcaggtgggccttccaaactatggccctgggtgtccacaaccttacagaatgaagcttgtggaacttaaaggtgaggaaagcctacactattttaaaagccacatgaagggtaagttatagatgtaccagggtctccttggcatctgtgctgtataaaatccatagacagagcagccattggctcttgttcaaaccacaagaaagtctcctgcccactcctggtgcattctgggaacagatttgctgtctgcaaaggctgcatctgcgggtctggcgtgcaaaggagggtggttctttggctaatggtggacttgctcctaggcctatcccagagtccctcagctctcctagcaaacaaaatcccaattaggagaaaaataaaatgctatagatggctcctgagatgttgccagctgtttgggcttcaaaaatgccccgacctgaaagctggaagttctgagaaccgtttgagggcatggtatttttctgggcactgcttcaaaggggctgtggttgaagaccatgctgctattctggtggccacttgtgtgggataaagtttcccatgggcccccgtggagaggctggagcactctcaggggatagggggtggtctcagcccccctcaccgagtgcacttgcatggcagtaagcaagtcggcgcctctgacccctgagtgggcttgagcttttgagaggtcagcatgcccccttaaacttgatgtctcctcagagcacagcacagatgcccagccaaaacacccagggcgaaaccactccaagaggtgaaagggcttgaggggagacagggtacggcgggagacagagatgcatgaaatactaacgttgaagattagaaatgggatgtgcactggaatgagatcatttgtggttctgatgcaaagacccaggcttgtttctaggggtttcttggggcttcgggggcctcctgtcaatggactgtttggacacccatttggatacatgcaatcctaaagtctatgggcagtgacagagtgataagtctttatcactagcctcagggagtagaagcccacctaagaaatggcactgtcccatgttggagcaagacccaacctaccaagctgggagttaccgcccactgcaaggcacccctgtactttgttggactctctgttttctgtctctccaatgggctggactctccagcctccgggcctctgcccaaccatgaccagaaggtcctctcctttctctttctcttaactgtctctagtgattctctgatcccagctcaggcaggatgtctccctccggcgcctccaggctggctgggtgtgtctgctgcatgctcctgtggctccctggactataactccctgtcttcttgtctcacaagagtaaaataagcttcttaaaggtaggaaccttgtctgcctgcttattactgaatccccaagacatggcacaggatctgagatgcatagttcctcaaatacttctgaataaatatcagatgagtgaatcaatgaatttcaagtggacttgaggagaaggagggggggtggcaaaataaaacaaacaataaacactatggcagagagggacacaggacctggagatggggcctggataaacagcctgccatgctcttcatatttcctgagtgctaccacaaggaagaggggcagctggaggccagagggcctgcagaggagtcagcaggtctagcaaggagtgccttgggtggagactccctggggctaattttggtgtcaccactgacttccttgagggtgctgagccttgggatcttcatgtgttggtagcttttgggtgctgtccttccacagacacatcaacaagttcatgggggtctcctgtaatagggtcctgtgacttgcctctttttggaggtcagtcttcaatattttggaacaatgtcggtattcggcctctccagatcacatttttacttgtcccttccttttctgagtaactctatggaacaaggactcctgacccagcactccaggaagccaaacacaaaaccatccccgtcttcgttattgtattacctttggttccctcccacagcctcattcattcattcattcaacatttttgggaaccctggccacaatctaggctctatgccatgtgctggagtcccagatgcagtccctgccatccggtaattagcgatgctagtgagtgtccaaggaaccaatcattaaagaacacgtgctggaagaaagagaggaaagccaagcagaagagaggtggactagcttggcctggggtggacagaaggcttcctggaggaggtagcatttcagctgggtgggtcttgcaggaagccaaaggtgcaggcagatgcacagggaggaagtgattctcacctaggcaaggggcatcataggacaggttcatatagtgatgggggctggaagcttcagagtgatagggtttgaggtatggtcccagctctgaagagccatatatatgccaccgagctatgcagaataatcctgtagatactgcaaacccaagggaggtgtaggtgaggatgtaaatgagggttgtggatcccatttgttcctgggagaatgtgggggacttaggggagaaggactgtgtttcccactgtctatcctttggggctttgacatttcccacctgacagccatttgcagagtaaaagcctcagggattctaatcatgcttggtgaacactttgaggtagtcgcctcattggacccttagaaacccaggtcacagaaacaccatcacccttctgagattcacagtcctccctccccaggtaagtcggccctgaatccaggaatcagccagccctaggacttttgccctgtcccaggccaaggtatctgtacctttcttccaaattgctggtggccccaggaagaaatcaagagtggctgactttaagcagttagattaaacatcaaatgcattcatcccaagtccaggcatatacctagaaggagcgactcttaaattttgtcatttcattgtgtaaaactgaggttgccccttaacacatgaaggccagcatgggatgctaattttgtgttgtgttcttttgggtaatctcaaagttccaggaagcctgaccttcctaagcctgtgtttccttgcctccccttcccggccccttcatttcatctacaacagacgtcagcaggggccctgagtttttcccagaccgctcaagcagaaacccatcctgctcacaaggtgaggagagccaggagctcacaaaggcccctcctccccttccccgggaggtccaggacagggcatccccaggacagacctgccctggggaccccggaacacaaggcaggtactgagaaacaggaatctctgggcagggaggttttcatatcctccaggtttaatagctttccctgagatggaaacttgggttgaaatgatttgcagctttccagattttctgagtgtgtgtctttgggtttatttttagccacaggcattcatttcttgccaaaaaaacctgcttaaataaaaccaagattaatatttttacttaacggaaagagttagtcaggacaggctttgaactgggactccttatcttgatggggagtgcatgttaacggtctggccttggcgttgacatcaacgaaaagggcctttgaaacggacaagagagaagggccctgggggaccagggtaggatgcaggaaaagcctatttgtgggacttctctgaagagagagagttcctcttcactcaggctgctcgccgctccccacccccagcccccagcccccatgctcttgcagtgggaggggggtcatcatcttcctggaaaggcgggagatcggctctggctttgctcagagcccggctgtgattctgcctcacttccagctgctctccttaccgccgccccctccgccccccacccagatcagatccagacttcttcctcctctggattcagacgcagcaaactgagtctcttctgcaggatgggctgaggctcagatctgatgccatctccagggcgattccctgacacccctcccctgagatggacttcatctcttcttggctctgtcctggctttccgtccttgcttatattgctgagcctgccttacttgagtgtcattgctggtctctctcacctctggcccttgagttcctaggagccttatgtatctctctatccctgtatacgtcttcacaatactgaaacaccttcctggttgctgaagagttgtgtatctgaccctgtgaaccgagaattgctgttacccccttttgattgaataagacttagaaagactggtcatttgacagagcttgcacaggaattatttatctgtttttaaatcactctgtgtgtggcactttatacaagaaatcacacgtagcttcccatattcagcaaatacatatgaggtgcctgttatgtgccaggcactcttcgggcagctttggctacagcaataggtaaagcaaagaacctgctgcccggggaggcttacattttaatggggagagatgatcagtaaagaagcaagttaatgtataatgtcagatggtggccagtgtctgatagagcacagtgtcaggggccaagggattgcgaggagggggaggaatgtgcatggatcaggatcagggaaggtcccccgcccaagtgaagaaagagtgttccagcagagggaactgcaaggtcagagaccctgagagcatgcttgggtgctagggtgtgcagtagagtgagctacaatttcctgagattaagaaggccatgagagccccgggtgcagggaaggcctgttatctggagctcagtgttggatgggtcgaatttgagatgttttattaggcttgcaggtataaatgtagactaaatgtagactctgggatatataagtaaaaagatcatcagggaggggaacaacatacactggggcctgttggtgggtggggtaggggagggagagcattaggaaaaatagctaatgcacactcggcttaatacctcagtgatgggttgataggtgcagcaaatcactatggtacatgtttacctttgtaacaagcctgcacatcctgcacatgtaccccagaacttaaaataaaaatacaatttgtttaaaaaaaaagttcatgagagttctaggttggcggtggcaaaagcgtgggagctgtcagttgtgcagatggtgctgagacccacaagctggaagaacatagcaggaccacgagcctgcacctcgatgaccggactgagcaccaagaaggtcatgggtgacttcgacaagcactgctttggagaggttaggggggaggctgcctaggttattgcaggcacctttggaggctggtaattatcacccacaatttatctgctgggatgggaagtgacttgcccaaggtcacagagaaacagggcagcgacttcacccagaccccacgtgctccatgcctgtttttcattccagtacgccgtgatcacttctccagttttcttgatctgtcctttcagcttctgagtctttcaggagggtttttttgggagttgggattgtggtgatcaataggctgggaatcagagggacccagtccaggcaggcccctcaggcctctgcttttcacccttagttccgaaggccctttcctctcacctagacatcatcaaagcatccccagagaggcagcagatatctgagaaggaccttgggaagggtcactgaggaaggttctcaagatcctggggggatgaggaaatgctgaatcacaagaatctttcgggttcctcttgctgttttcctctgattagtaaatttaagaatctacaagtcatcaccatcagcaatataacagtgtatcatttgtctagcttcagggttacaaagtacctttgtacatatacattgtctcatttaattaatcaatctaattaacttcaaacttcctgtgttgggagaacccttagggagcctgtggttttgtggtttctaagttatttgtttttattccatgaaagccttgccggggagcacaaaggtctaaacagatgatacgatatactgttatactgctgatggcgatgacttctagatttttattactaatcagaggacatgtgtttgtgtgtctgtgtaagtgattgggaagggtggtgggtgggtgatcaaagggatgtggggctcactgggagcttatcaagggtccttccttttaggtatcaatcttcttctctgatcctctgcagtgaaagtggggaatgcagtaaaattatgaactattttgcaaccagtgtgaaatcccatgtaaaggtttttaggtggtctgctgtcctgggggacctcccatttttttttttcccccactaggatgcaaaactgcttacaggctacctgatcctcattgtccacagttggaaagtagggacattaacagccacaacagtagccaccttaccagcttgccatgaggacagagttaaagaacatgcacacgttgcttggcacctaagaggcattcgataaatggtagtggttgttatcagtatgttctagttcccttccttctcctctagattcactaatgtgatgctaagaaaagcaagcagtttgtaattcttgaatgggtgagcagctggaagagtgagagagcctggctctgccctccttgggcaggctacattgtagagtgtccaaggtgggcaggaaaaaggcttgcttggcgggctccaggccgacctccctgtgggtccctgacctattgcctttgccatgagcactccggcctcagcaaggccgctccctttgtcatcctgtgggagatgataaaatacacacgaaggggccgtgagacaagctgggtgacagggatccctctttcctcctttttggtgtgttttcatgggtagggcatcattccaacacttccagatccctcttttcctccaagtctaggccgaagatgcgagcccatggtccaggcttttcttcctacctagagcctgcctgctggggtcccatcagaagagcagccccttccctgggactgacactaacagtgacttctgcatttgaagaaatgcagtctacccactaaccagacgtcccttacttatccttgctgtccttttaaaaaccatgccttaaagcagcaaaatcattctatggggtctttggagagacaggaatgggggtgttgtgtgtgtgtgtggggtggcggtggtatctcacctgctagatagcatgaatcaactcctaagtcatggagaggatttgtactgctcttccgttgatgctaccatgggtggaacctggactcctaagttagtatacattaattagttaaggagtccttgatccccagaccagccaaatgggtagcattgttgctcggccttctagtctgccagtaggaaagtccaaccattaggtcggggaagaagggtctggatttggttgacaatggttggatgggggatagaagcagagagagagagggagggcagctcaagggtatcttgccccactctgtttatgctgatgaacagcacatgtgcaatttctggagacacaccagtaagcttttctggaaactcaatcccaattgccattggaaaattgttctttgttcaaaacttgtgccactgtggtccatactgctagagctggaggtggggagaggcagcatgaaggtatatttatggaagaggtgtgccttgtttgccttgcttttgtaagctcttactagcactcttgcccaaacaaatattcaaaggaagcaaagacagttcaatagagatatatgcctctatgcctggcttctcaggcgcatgatatattcaagagggccccatatatatttatagatcaatgtgcccattatataagttcacacatcctagttagtttcttcttagatacttttacattgaaatactgcttattccttaatcaatctcttccttgtttcttcttcttccttttttttttttgctgagacagagtcttgctctgtcacccaggctggagtgtaatggcatgagatatagctcactgtagcctcgaactcctgggctcaagcaatcctcccacctcagcctcctgagtagctgagactacagatacacggcaccatgcctggctaattgttttaaatttttataattttttattttttatagagacaaggtctcactgtgttgcccaggctggtctggaactcctgagctcaagtgatcctcctgccttggcctcccaaagtgatgagattataggcatgtgccaccacacccagcctcttccttgcttcttttgaccaccagatccctagaagcccagattctcttcctaagagcaaaagaaattctagagagacaagagaggctcagaggctgagattcacactgagcctcacctctcccttctctgattggtgcttctgtaccttggagactagtcctctagccataaactttttttttttgagatggaatctcgctctgtttccaggctggagtacggtgatgcaatctcggctcactgcaacctccacctcctgggttcaagtgattctcctgcctcagcctcccaagtagctgggactacaggcggccccatgcccagctaatttttgtattttagtagagatggggtttcaccatgctggccaggatggtctcaatctcttgacctcgtgatctgcccacctcagcctcccaaagtgctgggattacagtggtgagcctccacacccggccagccataaacttttaaaccttatctccccactagactagccatcagtggaagcgggaaataggacttctatttcttgttgtcaccctcaccagcacccaacccaatgttccagacaccaacctagttcatgcctatgttggtttgattgttgggggcactgggtagacagtgtaggggccatactccagcatgaatgggaataaagacaacctgtgtccagcctggcccatctgtaaagctggcttctagccaccacaacaaggtggaaggaatggctagacatgctgccagttaccagtttgaaaagtgtcttctgttgttggaaaagcacaacctcctcccaccccacttcccttgttccctgtggcccctgggccagcgaatgcctcgggagaaccctgattgccaaacaggagagtacaaaatagcacacatttgaattacagaggagaaactggagcaaatacggacagattaatgcacaaaccaaataggtggatctggggttggccagcaattctactttggaaggactttgagaatctatttggagggcagaatgtaacttaattttagttcagtttagtgaagttttgtttttgtaaggaaaacactgatgtggcctcttcactgggccatctctgcctcagacttttggaaccatgactgtgatcttgtttggctggtcttagtaggcaattcttgggttacacatgggtgataaggtgggatgggtacatgtgatagagtaggcactcctgatcccaaaatacctcctatacttgttctgactacttcatctgtgcttctccacctctccctgaagttctgtaaggctagaatatttttatgaggttgcctttcttctcatcctagggagaactcccaggccttagcttacagtgcatgttagaagtctgaagatggtatgccctaagatggaataaaaatagacatcaccatagtggtgataatgctaataacagtggtagcaaacacatgaggtttgggatggactacatactgttctcagcgcttatattaatacgaccctcacagcaactttatgaggcattgtttcatcattcccatcttacagattgggaaaccaaggcatagagaggtttagcaacttcctgaaggtcacccagcaccagggctgggatttgaaccctggctctcaggctccagagaccaggctctttaatgcaatgctatgttgctgctccaatagtaataagcaaatcacttgttagccacatgagaggcactgggctaagaaagccagagagattcaggaggaaagagccccagagagatcatacagtaatggtggaacccaaacttcaatgcagcttcctgactacaaaaacgtattcttttcactgaactatcctcagatgaaaaggttccaagctcaggctatttggggtaaggaaggagttggctggttgtatgtgcagaagcttccagcagtactcagctttatggggcaggtctgcttgtgacatcttctgtctaaatcaagtcaagccatttttgaaccaggatgttgctatttaaaggaatcccttttgccttgcccctcccacaccccccggccaagactcgctcccttgtttaccttctgtgttaatgaggcagagaagatgggtccaaatcatttcaggaagaatcagtggtaaaggctggcagacatgcctctgcacggaggtgaagctgttataacctgcctgtgagagttaatatggaggaaacagtccccggggcctccgggaggctggcttgtcgccgagaatactaccgcaatgttagaaacagaggtggatgcaggatcttgacagacattggcctgggatcttgccaacctctcgtttttacagcagacttggaaacaaccactcgcctcctcctaatttgagctgcctccgctaaattgctcactttgccaatgactgtgtgttttgccatcgccggcagggaaggtctgaaggggccattgattcatctgaaccctgacttcatgtctgactgcaagggtaggatccaagctcatttggaaagaaacaagacagaatccagtatggatgaggaatcagttcttagtaaagattttttaaaaacagagattagagtcaaataactgggatacatagtggagcatccacaatgaggaaggataatggagctaccaaaatgtgtgtgtgtgtgtttgtgtttgtgtgtgtgaagggtattttacttaacaagcatttattgagtatctactcctttttgggctaagtgcaacttgagataagaaagattgataggatctcagggctgaaggagttcaatttgtaattcaaagtatgactgcataagcaagccccattccaattcctgttgaggtcttagcatggaagtatccagcaccctcatcacaccccctgatagaggcactctctgccctaatggcagcccccctgccttttgttgctggttcttattattagacgatttttttctttggttgagccaatgaatgttactctctgcaatttccagttttggtattcaagacctgtccatttgctcctccatgtgccaattttacaaatacctgaagacagctcttgggtgcttctttttcacacaacgtagaaagagaagcacaaccttgtagaatctaaaagtcaagtcctctcctctttctgttcccagtgcatgtggtaaatgcctctctttcagccctcaacccactgggtgtaattacttttgtattcatagttaactagtatctactgggtaaatcctttctgccagacattgtagtgggaaatttcataagatctttcgttcaatcctgattccaattccctgatgtaaagagagttataccctctttatagatgagaaaattgaggctcagaaagaggaagtggtttcacttcttggtctgttaccttatctagatcatgtggatgctaatactgcccttgtaagacagttaagagcagtaaataagtgaaatgtacatggcacatagtaggtgtgcaataaatgggagctgttttcattggaacagcccttccatggttagcccatttcatttttggtgatgataatgatgatgatattaataatatttgtctagtgcaaactatgtccaagacagtatcaagagtttcacatttgtcatcttgactaatcccttcagttcaagagattagtatcattatgattcctgttttatagaagaggaggccagaaacaaagttacttacttgcatacagtcgcaatagccataaacagcagagctgagattggaacagttctgtctggctcctgagccccgactcccaattgctccttcttctaaccacatccccatagagctcagactctattgcatcccttgctatctaagcactggataccaagggctcaatcagaatgctaactgggggcactgtgggaagctagggtgcaccacaaccctgtagacatgtcaagatgtggtgaattaatgcatgcaaaggaagagccccaaatgaggtggttagaaaggggtcctagtggaaagagaacagatctgggagaccatggcattgtcagatggacaagggaggggggacaatggctctaacaggagaagtaggttttggattatggtaaagtcacaaagtcaagaaaatcctcagggtcggcgggggttgactatagccttggaagttctggagctggcaattgtgaatatttggggtaattaacttgaatggtggctgtttctttttcctccaacctccctctcaccccagggaattcccactcttgtaaacacaatcatctattccagttggctccaaggtaagagtgcaattccaggctccacagaggctagcgtgcccgccctgagatgctgttcctgatgtggttcaggccttcctaacctcttattgtctccttctgtctctgcagtgatccgggccaaggtggtggggaagaagctggtaaaggaggggcccttcggcacgctggtctacaccatcaagcagatgaaggtaggtaatgtcatcaccctggctccgggaaggtttttgggtttttgccagaagagtcctggctaagggaggcaaagtgggttggaactggggtgtgtgtctaagcaccagccagacccagcccttctgcctgctggagagggagctgctaaggctgcataaagggatgggtagggagggggcatggggctgccttgtccaagagcccatgcaggtggagtcactccaaggcacttgttaggaagctgagctctggagccagatggcagatagccttgttagctcgtaaccatgagaccttggtcaagtcactgcccctctctgggctttaatcttcccaattgtgaaatgagggggttggactagatcatctctatgaactcttctgagctctgactatctgggactcaacagtgcttacaggtttcatgcagccactgaggttacagcttaggtttacagccctcaaatctttacatggaaactgtgctgatcacaggaacctcatcccaaggcaggaacttcaccttctttccctattttcccagctgattgtcttcttgcatcctagatagttagcaatgtttgctaagcatattcttatcattaaacatattactgaggatatgaacatcatgaagtacaggaaggaggtatgcccttaagaaaaagaacaccagatttgaaatctagagaacctgcctcctagtctcacctctactcctaaatagcctgcttaccttgggcttgtcccttttcctgggccgcagttttgccacctgttaacagtgtggggttgggcttggtgctcctaacatcctctctagctcaggcattctaagcaccctgggatgcgggccatgttacttgtaaggaggagcgggtggtatacaatggaagggtgtactggtgattgccttagcacagaagactggggcttcaccttgaataactcagcaactggttcatcaccccatctttgtaagcacctctctacatgcagagctcccagctaggagccagggaggccgtgagggagatacagtttccatctttaggaactagagtcaggttgggagagaagaggcaggtatgtgtgtgactcatcagaagttcaatgtggggtgtgctgaggtccacaggaactgtccagccctttaacttattgctcatatttgcatccctagcaattagggtaggacctggcatgcaaaagtgacttggtgaatgcttatctgtctaatacgggcatgagggtgagaccccacaggcctggaaactccccagaggagacaagccgcaatgtccaggtagaagggagtggaggagtgacgcagcccacggtggtacccaaccatccccaaggccaacctccaggctttcttattcctgtgtcctgaggctggatgtactaattttgtggaacctgttgctttggattcaattttgcaaacatccacagccttctggttatgtaatgtccagagtcagccctggccagttgcccttggctgcctaagcttggtcatgagaccagcttatgtcttcagacagccctggggagagaaaaatgggcaggggtggggaaccagcaagagcaacaacaacgcaaaaagcccactttgcaacctctggcagacagcgcgggaatgccaaagcatattagaccaaagcagaggttcagaaaacacacgaacctgcctggtctggaacaatcctcattacgagacactcggtggtcagcagagagctgagagggaaatagctgggaggcagcagttcctaagcctgcctggtttccttcctaccatcagggcctggagaccagggtgaccagaggcccttcctgtggacataatgtcccattcccccttgctggtgtcagaccagccacgggtggttgtttagagaccaaacaacacttgctagcctatcagcatcagacactcccactcccaggctggtgggcttagaagacacactcccactcccagactggtgggcttaggctttcggttcaccatccttcgcctgagctcatgaatcatggtgctgggaattagatgtaggatccctcgtcttacttctgacagaggcgcaaaggggaaatgacttactcagagtcaagcatttaactaagggcagatctgatccccaagctgaggcatcggaatttcttcccaatcctgtgttctttatatgactcccaaatctccctgccatcttaatcatcagtcaccatctcatgcctttcattcactctgaccctccatagagggtatcatgatccatagaactggtcagtgcccttctatccagagacaccactggaatctgcttgtctctaggtaccagcctgcaagtcagacaagatacaggctagaagtaatagtccgtccatccatcctctcgtgcttccttcccaccctctctctgtgcttagtactgtactatgaactggggatacaaagataacactgcttataattatgataagacttggcatcagttaacatttactgagcaattgcttagtgccaggcattctgctaggtctttgcatagatcagtacttatactaacactgtaaaatagataacaccttgtcctctgtttgacaggtgaggcaactgagacctgggaggtcatataactgttaagattatatggccacaaagtggcaaacctgagcaaaactacagggtctttgcctataaggagataatacagtatggagcagcaggctgattcatcattcctacccactttggggtatataaatgcccactccatatgtttttagttcccagggaacaaaaagaggtcagtttgggtttgttggtttatcatccagcagtgtagggctggacttgtaatatcctgcaaagggtgtatcagaaaaatctttgtaggagggaagagagagaggccagagaggcaagcctgcatgagttttggcactggtccctgggagactttgttctagcagattagacagtctaccctagagagtcagaaggggtgagcaagggcttccttagagcaggactaaaggaacttggagaacctgagactccgagccgccctgtctgacctctctcttctctcactgatggaaggcaggcagaccttctcccgtctgctaactctggagcctctgacccatctctcaggaacacttcagtacacagagacctgcgatatgtgtgtgtgtgtgagggagcagggtgttagaatgttgagagagcttattgcaatcccaaacttggaaattagctgggctgtggggtgaaggtgaaagtttccagaactggctgctctaagctgtggggaccttatctcccatcaggaccatgagaaaccgatccactgtgccaggagttattgtttatgtagcggagacatgctctccagctggctgcaggggacagaacgtgggggacattatgtcccagctggtcctgggagggtcccatggggagacccgctggtcatgtgctttgcatgtcctgactgtaggcagagcagacctccagggacttccttcctttagtggtttgtctaaccaaatgagcaatagcagggtctcgcctttgaagctctagctggaagcatctttgacccccagcccacagggaaccattcttcttgcaatgcccgtggttcttcctgccttaggactctcatccagccctctgcagagactggctccatttctacattctctgcctgtcctgctagacaaattgctgtatagagaaagatcatggccgtgatagctcggtcggtctgtaaataagaatttgtgggtttaaatgagtccgtgatgtacaccagcatccagaacagtgttgatctttggtaggcatgcaagacatagttggaatcattgaggcaactcatgctgtcaatgtagagtgaaggccagacatttcataagaaatatgcaaatgtccccagactcagaaacttcttttttactttatttgtcccttcactccaagggaagctaacatcttggaactttgtgtagatgctaccaagaagaagaagaggggcccagaggcatgcagaacccagctgaaaaagaacaacccacttatgtctgaagttctaaaccagctttaactactcttgttaagagctgaggaagggacttaggagaaaggggaccaaactcattcctcctctccttacgaatttcagtataacttgttctaagctaacttttattgaatgttgtgggctgactgctattctaagtcatttgcttctctcaaacaccctaagaagtgctttgacccattttacagatgaagaaactgagacccaaagaggttaagtaactttccaagtggcgaacacaggtggcagagaagattgaagattcaaactctggctgtcagcctccaaaacctgaatttaccactgatctccatggcattggtttggattagattacctttaacatcttttccaactctgagattctaggattctctgatgtcaggacattataaacctattataactctcctaaatttgtcaaaccaattctagatctctatgattacagacatgatacttttagaatcaatatttaaatcaaggtaggattattacacagaaaacacaactgagtagaatctacctttgccatgttgttcttttcagaattgaccctaaaacacagcgctatgtttgtcagagccagtcatttgtaatgtgtcagaatttcgactctaggcaagtgctaggagctaaaatgcaggttccttcaaacttccaagtagctgcggtgccaagctgatttcgatgagttgagttcttactgagcagttcaaatgaccagactgtaaccaggggcttcattctctcacccacgaagcactagggcagtcaaggggaaagactgacgcagaaggaatgaggttcccatgggctgggtccaaaagacctagagcgagtgcttagttgaaacatttgccaaaacctcaaggaacacccacacaaaaataagaagttgctcggcacagaagtcagggtaggggatgttcttcgaaggccacactccatggcaggcatacagcagcacgcttaaacatggttcctgttaaggctagagaggcaccattcacatagaagaagtcatcatcgtgactctacccaccccgcgcccccaccgcgtaattgaatgctgagtgtggacggcacttcttccagcacttggctgcgttaccgtgctcagttggcaagccttgggggagaagagaggttcagaaggaagaccatctgagtccatcagaacaatgtgtgcttttaacaaggcaggggcgcccaaactcagtaggtccaacagaccaagttatgctatgaaggtcttgtggaccacctacccccgccaaccagtcaccacttaaaagatgagaaaacgccagctcacaggccaaatgggaggcatttagaagagacaccaatgaagagatgtctggctttgtattaattactgtaggtaaattaataccaaatgccaggaagtaaagtagaggcattttcctattataaacccttgggacaagcccagagaccaccagcagtccagggcttgtgtacgctgagaactgaggggataacagaattgtgcaacaccttggtgccccaccgcccccgttaccaaatctcacagttcacagtatcgccttggcacactgggcttgtgtaatactcatggacttgacctggaatcacaaagcggactcagcttctgttacattcattcaccccagtgactctgggcacacactgtgcctctgaaggaggcacagtggccataaatggaaatagcatttgcctgcttctggggaccttggtcatagacttctgaggctttcctgggagccagtctaagataatgggtaagagtatggactctgaaggcagagtcctctgcttggaatcctagccctgccatttcccaactgtgtggccttaacaagctacttagcctgcctgtgactcaggctcctcatctataaaatgggcataatagttcctacctcatagggttgtcatggtgattcgtgggctaatattaaaggagatttctcaacctcagtaccattgacatttggggccggataattctttgttctgggggctgtcctgagtattatgggatgtttagcaacctccctaccctctacgaactgttgtgacaaccaaaattgtctccagacattgccacatgtcccaaatatttcctaggggggcaaaattgcctccagttgagaaccactgtattagattatgtcgtagatacaaatagccaaatatcagcaatttcacgtggttcaatctaacaattataaagtatttaacagttaaaactctttgaactttgtagatacatttatgtgcttcatctgggataaacgaacccaatgctttcaccagacgctcagaagaataaaaaacatggagaatttctagcttgaattcaacgttcaccagccaaatagaatttctataaagtggggtttgtaatacatccctcccagggctcttttaaggatactgcaaggagaatgtgagtgagaatgtttttgtgggctggaaagtgtcacagagatatcatgagaatgctggctgagttcacgggactcaggtcctaaggttgacaaagaaaaaggacctttgtcacagctacttctctggatttctgaaaaggtgctgggatgtcagacatgtgtagccgaaggagtgttgtggggcagttggaatggggggtatggctggctgcacaggaaggtttctctgggaaggcaccaacctggctagtcaagaggatcggtggcttcatctggggtgaagggggccctggggtgggtagatcagtgaccggccactggacagctgaataggggagcgagattccctcagatccaatgtcagcaagccttctgggtactgagactcctctcctgtgttcctcttattttattgatacataataaatggacatattttgagagtccatgtggtattttgatatattcaaaaatgtatagtaatcaaatcagggtaattgggatattcataaccttaaacatttatcgtttcttcatgctgggaacatctgaattatcctctactagctactttgagatatacaataagttattgtttactgtagtcattctactgattcaatgaacactgggtcttacttgttctgcgtactcgtatttttgtacccattaattatatctctttgccccaatccttattacctttcttgcctctggtaaccaccaatccactgtccatctttatgagatttactttcttagctcccacatgagtgagaacatggtgtatttgtctttctgtgcctggcttattccgcttagcaaaacgacctccagttccagctgcattgccacaaatgacaagatttcattcttttttctggatgaatcatattccattgggtatagataccaggttttgtctatccattcatctgttgatgggcacttaggttgatttcatatcttggctattgtgaatattgctgcagtcaacatgagagtgcagacccctcttccatattccgatttcctttcctttggatacatacccagcagtgggattagggatcatacgggtgtccaaactgggaaagaagaagtcatgatgttccttttgcccacagatgtaccgaggcttcaccaagatgccccatgtgcagtacatccatacggaagcttccgagagtctctgtggccttaagctggaggtcaacaagtaccagtacctgctgacaggtaatggccaactctagcttctaggccagggtttggccaaggtccactgtttcttgacttcagaagaacacatacggagtagttgactcaccaaatgtccagtaaattgtaaggagtctctaatgttgaattcatcccacttacccagtgctaggagcttgaggctcctacacttaggctggactttggaattagctccaccactcacctgggggaggaaatctcctaatttgtagcttctcaactttactgtaaataaaaagggagtatctgttcctctccacctcacactcgacctgttaggcccgtctttgaaagttattcatctttaggcagtcagtgtagtaaaggagaaaacaaaaacaaaaatcattataaagggagtgaagagttggcctctagtcctagctccagtatttaatgggcttgggacctttggcaaatcactttacctctccaagcctcattatcctcatctggaaaatggggctacagtccattttaaaaggtgttgggtagggtgaaataaaatcatgggtctgaaaagtacccagccacagtgcctgggctaagtgggaacatagtaggtgtgaattctctctgggctaggctctggacaaaacaacctctccttgttttcttctttcctcctgtaggtcgcgtctatgatggcaagatgtacacggggctgtgcaacttcgtggagaggtgggaccagctcaccctctcccagcgcaaggggctgaactatcggtatcacctgggttgtaactgcaaggtaagctctggggtcactgggggaaggaggggaggtgctgacttgcagccctagaaacatcagctcccaatgcactgggtgccaggccctcggctgggaagggtatgcatgtgttaggccagggcagaggggcaggtctgagcagatatagtaaggattgttgccccaggtggggcagtgaggaaggcagggaaggaagaatgcctttctgctgtaatcggctgcctccatgatgaccacttggaagctgctggggcatgagggctcttgagtccctggccccacctggcagttcaaggctggaggtataggatcctgacactggcaggttctcccaagtggtttcaagtgggctcaccctggtagctgactcatcgctaaccccaccccaggtaggcaaatgggcccaggactgcagagaccagatgctacagaaggtctctctttaccaggcccatccccctgacccaagtatagggccaaggtgcagcctgcctgctgtgggaggaagttgggccattctctcacttcatcttcaaaacagtcctgtgtggttttaattactatgatctccattctgcagatgagagctcagagaacttaagtaactagccctaggtcccacagttcactgaatctggtttccaacctagggcagctagactccaaagtttatgctctaacctttctaattcctcgattccctaaaacaactgagatctcccacctgagacgaaaaagtcctctcagtagtctaattctgctacttactggctgtgtgacctgcagcaagttacttaacctctcagagcctcctaaaactgtgataagaattaaagagaataatatcaaagcacttatcagaatgtctgttagacagcagatgctcaagctagtgctatttatattatgatcactgagggactgatgtggctaggcttcccatgcagtggccccagggtctgaatccaggctcggtagcctcaggcctgggcataccatggcagagtccatcaactgctgcctgttatctaattgcagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgtttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcacacatctgctgtctcttgccttgttgtgttctgacgccacggggagttatgtatacaccagcaggccttgaaagtctatccccagctccaggcctggacacatccctccctccatgcaccgctatggcctggccccaccctgctccagtccttttcccttgcagaaggaatcttaggagaggtgccctgccttgactttgctccctgattctattgctagagtcctccctagttctgctgaatctggatgtattaatatatctgtacctaatcacctattggtggtacaagtacccccagactggagtccttactcagccctccttgttttcttcctaagaatcccaacctggtggaggtggggaggggcggcctgcaaacagcagtccttgatgtcaactgcctgcttgaaattccaagtatggcttggcctagttgggaacaccaggaactcatgaggtctcacgacagctggtgaccttttcccagagcttataacaacctcctttcagagtatacagcagggcctctcactgtcaatgggctgggctggctgcagacccctcgcctgactttcatcccaccattgacaacgttctaggttttcacccttgttttaaagctactcctactatatgccaggtacagcactttatatacaggatctcatgaaatcctgactactcgatgaggttgctccacaatcatccacggtttttacctgaagaagttggggctcacagagataaagtcattttcctgagacctagtgtgtagacagaactggcattcaaattcaggctagtttgataatgaactctgaattttccccactgtaaggatgcatacagtaagaaaaatccagggtttggggatatgctgggtttcacatgtgcccttcttatctcaaccagcatgttctggattctgtgactcttgcccgatcagatacaggggaaagatcatcaatagaaattctgcttggttagagtgattactcctgaaatctgcagtcctacccatcagtatctccaaacaggactgtctagcccagaagcctgagcttggactctacaaacagccacagtaagtccccacctgggactatggtatactctattcattattctgttcccaaagacgcattccctgcaaggccaagcgcagggtcacagccttgaattcctttgaccagtttacgaagaccatcaactatgcaagcaggcatgttgcaggctctttcctgctgcttagagctcctccccccaacactttctggcttcaggtggagaacccttcacctcattcagaaagacattcacctcttccacccaggtatcctccaaatgggaggctgtaccacatatcctgagctaagccctgcttcccagaggagatctcaggtgcattcagaaattggaaagtgaagaggacatgtaaggaaactgcccttcaacaaccaatgcaaatcaaatattaatattactgctttttattaaaatatgagttgaaatcaggttccacaaaaggctcaagtaaaacaacatcccaccttgaaaacatcttttacctttataatcagcctctggttctaacatgcccccagaacgtgtcccctgatttgctgaaaatctccaagttccaaggaatgtggttcacctttgttatttgccctattgcctgaatttcacctggagagacgacttcccttaggaaatccaggcactcccacaggacactgtgactccgccttagagtctgcgtggtcagtgtacaacccctagagtccacctcctccatccaaagagaccgaggacaagtcatctgtattcattccgcatcatgcaaagaaacagagtaaaaaagggcactcaccattggcttatggttggggaaaaatgtttgctccacaagcgggaacttctcaggacccagggaatggaagatcttaatgagctgagagaactaggatagaagaggagagaacattgatcaactattgtcacccagtataacaaaacctcccacttgatctgaggcctcaagcatctgactgttctgagccgagcttcagtaggtgctatcctaccctgcctataggataaagaccagattccttggctggacattcatcctctccatcatctagccatattaacccctccatttctgcccaagacctagtaagtaggcagaacactgggttcagcccaaccatatttaatgagcacttactatagcctcagcatttcacaccatgtccttctccacctgctgatgttcatgccctgctccttgcctgccataccttctttctagagaggcagcgctgcatggtaattgatggtgttagatgtggatccagccttcctgggttcaaattcttgctttgccacttactagctgtataacctgggaagtcaattcaggtttctgagctttcgtttcttcactcgtaaactggagatccaacctcatgggattgttgtaaggatacagtgtgtcagaggcagtgctttgtccacagcagtgctaaaatgctaggtgttatattaataaatattttctctgctgttgcaacccctctcatttccaacagctcaagccacatcccttcccactgctctcctcctgcttcaacacttgcttgttttgccagatactagctactgtctccggagctcaaaggtgagctctgtcgctatgctttattattggagcaacaagctgaatatgggggcaaggcctgaaggaagacaggctgcaggtgcatggctgtgacactaatatcttgctggagggaagcatagggggtgaagggacctggaagggggacagagtagggagtcaggatgatcccctggagcagacgacataagagaaggagaaagggccctccgggtgtgcattgagactaatgtatgctggagaccctctgcagctgccatgctgtggcgtcagttgcaggtgatgatgagagacgaggtggaagcatgatccatcacagaccaccagccttaaaggcctgaccagaaagcttagaattcacccagaaggtgaaggagagctgctggtggatataagcagagaagagcaaatcagattccgaacaagataaaggaatcaactggaatttgtggtcccatgtggatgcccagtggttaaaggagtggccaacctgacttggaggtcactcaatactaagagcctggacactgaaaacagagtaactaggaactttctgcatccacccaagattggtctgcaaactcttggggtatagccttcagatgcagcacaacagggagtcaacttcgagggtttaagagaactcagaaatatggaaaacgatgtatgtgtgtgtggggtccctcattttgcagacaaggaaattggagtccagaaagggagagtgattccgcaggtaagcacatgagttttgaagaggcctagctctaccactttctactagctatgtgagcctcagtttcctcatctgtaagatggagatattagcaactcctactcataagggtgctaagaattaaacacaatatgcacgttaagggctcaggatagcacacggctagtgctgatgagttgtggttgctactatcgtgataactgtgataaaaggtggggaagggctaacaccatctaggaccctttcctaacagtggcactcgaaaatcttggatgccattggccaaaaagcccagttagggcagaatgagaaggagaccagggccatgacaatagtggtaaattctatccatacctattaaattaatgcatgtagccattcagtaagtactgagtgttccaactctacatggaacttgttccaggtatctaaggcagtgaaaatttttaccacttattgagtgtgtactttgtgccagccacattctaagcgttttcatctattaaatcataaccctaccaggaaggcgctattactaccaccactttccaaataaggaagctaagttcagagaggttaatggggttgctgctcgagtaacacagctcataagtggagaagcctggacctaggaatctggcttcagagctcacactctcaactaccaccctacaccaccaggtgatcacacagagagatagcaaaacaccacagaccagacagctatgagcttcatagagcactttctacataccccaagcctccacattacctatcctctttctgtccttgatcttcccccttgccactgatcataggacatattgcatatttggcataagtattaaagcaccgcacatgcccctgctcactagaatgtaagatccacagggcagggattttggtctgatttgttcactgctatgtttctaggacttacaacagcacctggaacacagtaagtgcccaagaagtatttgctacatgaacgaataacttctaatcagggagacagataatgcacaaatgaatggataaatttatcattctaggtggagataagtatctaggaaaaaaataaagcagggtaagggatttgagagtacttgagcgagtggaggagtggtattttttctttgagatggagtcttgctctgtcaccaggctggagcgcagtggcgcaatctcagctctctgcaacctccacctcctgggttcaagcaattctcctgcctcagactcccgagtagctgggactacaggtgcacgccaccacgcccagctaattcttgtgtttttagtagagacggggtttcaccatgttggccagcatggtctcgatctcttgatctcgtgatacacccgcctcggcctcccaaagtgctgggattacaggcgtgagccaccgtgtctggcgaggagtggtattttaagaagtctttcttacaggtaacatttggatggaaactcaaataaatcaaatgaatgactgaaactaaggaataaaagaagagaaattaaatgttgggtgttggagagagagatggcttaaattgtggcctcaccactcactgagcaagttccttaagtggcctgaagctgagcttccatctctgtaaaatgaagggttgacactcacttcacacgagagcgacagtttgagtgccaggtagcatagttttctgggacatagtaagtgctcaataaatggagtctgctgttaacaataatgatagaatgttcataaaacaatatggtgcatctttatgactaatattataacataacaccatatcataatgttatataataacatgttttgttattatatattattaatagcatatattgtcactgtattatatattatatattacaaagatcaattattacatatatgtaatatcatatatcatatattacatgtaacatgtataatatataacatgtatatattaacgtatatgcatttatttattacaaaactttttttcgagacagagtttcgctgttgttgcccaggctggagtgcaacggcacgatctcggctcaccacaacctccgcctcccgggttcaagcgattctcctgcctcagcctcccgagtagctgggattacagcgggattacagacatgcgccaccatgcctggctaattttgtatttttagtagagatggggtttctccatgtcggtcaggctggtctcgaactaccaacttcaggtgatccgcctgtcttggcctcccaaagtgctgggattacaggcataagccaccgtgcccggcctataaatatttaccataataatatataaaatataaaattaatataattgttaggcaacaattccaacaagagccctaggatccaagttcagttcagttgcttaaataagaatttttactactgaggcctccatgctggggagtgggcttgtcgcagagtgggaggccacccactgcctcccagatccctccaggtcagcctgccctgtcacctaccacccagggcttgctgcagaagttgtagacggagtagagagagttgacagcaggcagccctccatactgcaggccgatgaccaggctgcggtagtcttcccccagggccatgctgtaggcatgctggcggaccaggatgaagtctggcttgaaggatctgctgagaaagccaacagcagtgttaccacactgggacattgatgaaacaccagggcatccggccacagcttgctggggatgatagcactgacttgcagggcggcagcttagttcagaagtgggagcaggtgggggatgagggcagttaaatgcaaaggcacagctactccactataaagtcaaagggctggaaacactatatatattctctctctctctctctctctctctctctctctctctcacaggctctttcctaaattccctgcattgaacatctatttcatttgcaaccagaaaaaaatatatcaaagtgaatcaaccgagattctgcaaggtaccacgcactctactgaatgtatgtattatccatggtgaggacaactgccctaggaggtgagggttgtcatcaactcccatttcacaaacgagcaccctgaggctcaggaagactaagtcacttgttcaaaaagatacgctgcagagaggcagcagggccaggtctgtgtagcctcatggctccggctcttgttcctgcagatctcaaatcaaccaacacatcttggttttttttttttttttttttttcaagtagcaacctctggaaagcagcaagagtagggatttgatggccgagcccatgccaggctatttgctaggtccctctagagacaggatcctgatgagtgctcacaaacagacctgggtaaagatctggaccatctccccattttatagatgggaacactgcagcccagggaaattatgaactttccgaatcacaaagctcagaagcaggagagccgcattggaactcaggtcatctggctccaagtccacatgcttttgactccatcacagggccccaggaggattcacacattgtttgattcataccaccaaagatcaaactatttttggattccttatttttaagtaacacaaaaaaatcagcccaggctggggcaatagggagcacttataaccatttgctacttttatctgattttaaaagtaatacacattctttgtgtataaaaaaacaaaaattccttggcatgtacaaagaagtaaacaaaatgctcataattttacaatgcagaggaaactcctaacaacctttgtatatacatttttgatccaatgatcaatttcaatgtatataatatgcattcacattcataattgctccatactttcttttgattttaatgttttccacataataatatagtgtatatatttttctctactaccaaaaatatcttctaaaatataatttttaatttctacacaatagttcactgaatgatatatcataattaagtaaaccaatcatctactattatcatataagctatttccaatatttcatatacaaatcagtgccattattttaaattattttcataagatagatcctaagaagtgggactaatggattaaagggtgtaagctttttgtaagatacccaaaaaaagttccctttttaaggtacatctcacaaattgtttatgagaatgtccatctcattacagcctcaccagcactgcagtttttgaaaaatatttttttcaatttgacaacagaattccccccaaaagacaccctgtatcctgctattgttttagtttgcatttgtctgattctagtgaaattaaatgctttttattaaccatctgcattttctttcctgtaaaagtctgttcacatccttttccattcaaaacaaaatagggtctccagtttcctattgaggtgagttctgtgtattaaggatactgccctttatccatcatgtgtggcaatgtttttactagatgcttgcttgtctgtttctttttaatggatgtgcatcttaaaaaacaacacataaatacattgtccatggccctggttctgacaatgagacatccactcctccctggcagcgtgggttccatcacagacaacagtggcagcaaacgtggtgtcttactaagaataaccccatccttcttcatgaggaaataataaaaggtctcctgctggccagcctcctattttttttccccattgctgggaattcataagagggacatgggaaaaacaaaaaacaccaaacctggctatctaaaaaaagaggatgcccttccaagaccaccttccaagaggagaatcccatggcttgttttgggatccccgactctggctccagatattatggtgctctctctccagggcttccaaaactcacctctaaatcagaacctttctgattcctcaaaataaaagtagcaggaagctcctcattgtctttacggatttggaaatctacctcaagatcccacatgtgaagtgctcttacaaaattatacatcactcccctgcttcaaaccctcaaaaggcgtctctctttctgacaagagatccctagtgccttatcgtggctacaaggtcccaaatgggttgcctgccactccatcctcatttattttatttttttaaattattatttttttagagacagggtctccctctgttgctcaggctggagtgcagtggtgtcatcacactcactgcaccctcaaactcctgggctcaagcgatcctcccacatcagcctcccaagtagctgggactacaggtgcgcaccaccacatccagctaatttttaaatttattttattattattttttattttttgtagagatgagattttgctgttacccaggttggtcttgaacctctgaacttaagtgatcctcctgcctcaggttcccaaagtgttggaattacaggcatgaaccaccctacccagccttccatcctcattttctatctttctcgcctccctcactgccacacaagccacactgaccaccttctcttccttcaattccctagatgctcttctcccacattgcgtgtaggtgcctcgtcctcaaagccaccattctgtctactctatcaaaatttgccccaaccctcgttttgccctattttctttattcatggctctgtgacaattttatttctcctgtttgtttgattagctgcttaactgtctagttctcttttctaaagatgtcagctcaatgggaacagaggacttgactgtcttggacaaaataggcctcaaaactgtttttaaataaatgattgcatgaatgaatgcatatatgaacacatgaataaatgaatgaacatgatgtgaaatggccactggaaaggggagggatcactttccctgcgatcctagagaagaaaactagactgatagacatagtagccaggagacagcaagtagccccttattaccaaggggttgccttacaagctaacaagtaacaccacgaagaaattcataaccccagggaattcaaggtggccaccatgacctcttaagagtctcagatctaatatgtgaaaaataagcacttcctatgcacaatatatcaggccaaaccaggcatgtgttatagagtgaattctgccattcactgctacagaaggcatagagtccttcttgaaagtctagggtatgatggatatgcaatgactatagagaaattactgacttaagctgggcaacctgtggcattcagttcctccctctgtacccagcaccccaggttctccatctggccagggggtggccaagtcctgcagtcaccccaacatttaaggttgtgacctccagtagttaccgagcctcgacagtgggccaagcactctggcaaaggttggagatcccaagatgacagggatgattcctgcttttaagaaactcacaacccaagaggagttgggtgcaacgtgccctaagcactttttttttttttttttttttgagagacagagtctggctctattgtccatattgtccaggctggtgtgcaatggtgtgatcttggctcactgcaatctccacctcccaggttcaggcagttctcctgtctcagcctcccaagtagctgggattacaggcacgtgcccctgcacccggctaatttttgtatttttagtagaggcaaggttttgccattttggacaggctagtttcaaactcctgacctcaggtgatctgcccaccttggcctcccaaagtgccgggattacagacgtgagccaccgtgcccggccagcatttgttaaattaacaaaggagggagtgagtgggtgagtgagtgagtgaaataattgaggcatgtacaagggcataaggtggtccaaaggatggattcaactctgttaagggatgagtgtgagcaagtgtgtgctggaagccttggtcttaaaagctgaggttgtcaagtgggttgggtttggagagtattccaggcagggggaaggcacctgcgactgaatgaatgtgccctcgttgttgggggtgtagtggactgtgctggttttatctgctctgtacccagaactcctcctttttctagaaacagagcccatgcggaaatcctctctgatcagagaaccacattttcctgggctgtaactggtctaaggacggaacacctgatgtaaaatgggcctgtgagaaaattctcgggtgtgttgtatctgagctctgaaagacaggagtggccagctacactgaagtaatataagctgggctgatgggagaccattttcctgttacatgaagaaatcccatttgtagcagaagtaccagctgggaaaagagataaggagggaggcaagacacctgtcaacattagatgagtcggccaaatgcagtggctcatgcttgtaatcccagcattttgggaggccaaggtgggcggatcacttaaggccaggagttcaagaccagcctggccaacgtggcaaaaccccatctctacaaaaaatacaaaaaaaaaaaattagctgggcatagtggcacacacctgtaatcccagctacttggaaggctagggcacaagaattgcttgaaccagggaggcagaggttgcagtgagccgagatcgtgtcactgccctactgcctggatgacagaacaagaatctgtctcaaaaaagaaaaagaaagtaaaaagaaaaatcccccaaccttttaagccccttccttctcttcctgccgtagagccccactgagcccaagacctgggtctctcgtgcctgggtaaggtctcctttaatctcacacaaactggcacgtcctggccgcaggttgtagctgggttttcttgttatttcacctttaaccgtaatatgagctataatatttgggctcctgatcccaagtctttctcagaagtggctgttggcacttgagaggaaatcaaggacaagaaataattaacggtaaagatgggacaggtgacgtgtcacagggggattactgaatgcttctggcagcgtcaaaaagctggaggccagaggtgaagtgactcttaaccattggagaagtgtaataattctctcaaatatgcagaggtctgtggtggcaagaacagctcttggctggactttgcctgggacctaagttaatcagcagaagcctcattattctcagtcacttgaccactatttcataactgtcccctggtccccaagagccaggttggcaaagggtgatgttcatgctgattttgttcacatgctgagacccatcacacccagagctgattccagccaggcctgcgaaggctccagactttctgacgtccatgtcaacgggcaaagagacttcacgttttctcttaattgtctccacactcttcataacactccaccttggaaaattcaaccttgggtatcaaatctgggggaaggggacaaagggaaccgagtaaaccagcaaatggggagggggaattcaaaacattgaaacaagctccatgctcctgcagacttagggtaccactattctgcaaggataaagccaaggaaatgtgcacgctttgcagatggaggggtttgaatcgcccatatggaaggactttgggaattagtgatgcttcccgccagcccgaggactgcaagaaattagcccaggccaaaaagaaattaggtggcagccaaccaagaatctggtgaggagcagacaacaggatgcaggagggaggcctgtggggcccccatggcagctgccagatgcacaccggtggagaaggggcccggtggggtttacagacagcccggctctctgttgaatccgagggccctctttgtaaagtgctaggaggttaataaaacacagacacgagttgctggaggaaggaagcttccttgtctcgtttcagcctcacaatcctggtatctttattccggtctcttccttcctgaatctctgtccttgctctatcctcttcctcctggtcaccctgggaaccccacatgttatgggttgaactgttgcccccaggaagatatgtcgaggtcctaagcactggtacctgtgactgtgaccttatttggaaaatagggcctttgcaaatataatcaagttaagatgaggtcacactggaggagagtgaaccctaacccaatgactgatgtctttaggagaagagggaaattcggaaacagacacacacaggggaagagaatgccatgtgatgagggagtcagagattggagtgatgtgtctataatacagggaatttcaaggattgctggtgaccttcaggaactagagagtggcaaggaaggatcctcccctggagccttcagaaggagcatggcataggagtcttgatttcagacgtctggtccccagaatgatgggagaatgaatttctgttatttaagccacccaacctgtggtgctttgttatagcagcctcaggaaactaacacactgcacgtgcccactattcccttttccagtatctttcaggacttgctggcttcctttgttctggcgtacacccatgcatggccccattccccacttcctaaaacaacaaccctgacttagtctgtttgggctgctagaacaaaatactatagactgggtgacttataaacaacagaaattcatttctcacattctggaggctgggaagtccaatatcgaggcaccatcacatttggtctctgctgaggcccccttcctagctcctcactgtgtccttacatggcagaaggggcaaggcagctctctggggtcccttttcaaggccacaaatcccattcattagggctgatgacttcatgacttaatcacctcctaatggccccacctcctaatcgcattgggcgttaggattcaacataaattttggggggacacacatattcagaccatagcaaaccccaacaataaaaaaccttcactttaaggttccaaatggactggcagttaaatcatgttcatatttacataaaagaaggagtaagtcaacaaattgataaacgcgtggagatttgttcggatggatgttcaccaaaatgctggccttaaagagtgagatgggaaatgggaactattacattcttcttcatactttttggtactgcctgcattgttaaaaaaaaaaaaaaagagcacagagcatttttacaatcaggaaaaaaacaatgaggttatcttcattctggaaaaaaatggaaaatgaaacagtggagtcacatcatggaaaatgcttatggtacaatttcatgtgacataaaacaatagaatagaggacctgttttatgactaaagcactgtaaaaatgacaggcctggaaggagagatgaaaaccactcatttgttaaggtagtcaggtggcaggtgatttctcttcttttgaaaatttccattttcattatatcgcagtttgtgcatttactaaaactttcggttggtacacatgcataaatagatagataaataagtagatagatgatagataaatagacggtaggtagatagatagatagatatgagaaataagtcccctgtacttggccttgcagccataactagtcattccccttcctctgtccattgctatgcctgatggacaaggcagtctgtgccctctggccccaattccaatgtgccctctgctcctggctgttagtccctttccaccccaatacaattgctccgaggtcacttctaagtgtgaagcccccagatcagatggcttcttctgtgtccttaccttacccaatttctaattataactaaaacacaatgaggctctagtaaaataccatgagacttcaggccctctgtataacttcactcatttaaacctaacaaggaaaacctaccatgaatccgaggcacagagcagctaaggaactcaccaaggtcacgcagctattggtgatggaaccatgagtcaagcttcacagcctgttggctctagaatagggtttcccaacctcagcactgtggacattttcaggctggataattctctgttgtggggggctgttctgtgccttgtaggatattaggagcatctctggcctctacccactagacgcagcagcactcccatgcccagttgtgacaacaagcaatgtctcccaccattgccaagtgtcccctgggtggaaatgcaccctgctagagaagccctgctgcagggctcctcttgtcctctgtggcttctgtggcatgatcactgtcccccttctccgcaaaccctttccaccttgcctcgaagacaccctccgcccttgcttcccaactcccagctccttcactgttttctccctaactacagctcttctccaagagaagagctcctccaaggctcaatctttggttctctgcttcatggaatcatctccattcagggacttcccttaccttgtcctcataggcaataatgaaagtgattcagatttatagagcacttccttggtgccaggaataatttttaggattttacttatgttatctttatcctcatgataactctacaaggtagatacgataataatagctttatttttcaagaaacaaaggcatagagagatgaagcacagccaagaaggtgtccacctgggactggagtgcaggtctttgggcttcgaagtccgtgtgcacaatcaccgtgcaaccagaaccttccaccaccctgaacctctcatcatcacctccaactcaatgtgactggaccccaagtcatcagcttcccccaaagtggatctgaggacttctgttaaaggtctgtcgtgctcccaggaactgggcgtatgtcaccctgaagtcatgtgcagttcttctccctgacattccttaagtatggagccaccagagctgctaagtcttccctccagaagtgtctaggattggtccctacactctccactcctcatttccactctggttttctcctccaatgcctcatgcttgagacaccttaacagaccttcagcttctaaatcctcaacacaagtccttcatcttattcctctctgtagccccagcctagtccagggtccatacttctgagtgttgagtgttatgtgatttccctgccactaccccagggggccaagcaggtaccaccatggttgagtgaggtgggcctcttcggttttctcttctcacacacactctctgttttcatataaagcacataagaatatccttcatttccacaatgctctcttcaaccttttttggaagcaggcatgtcctttcacatatctttcattttgtcactcaatagtatgaagtatatttcacttttctgtaggagggcacaaccactaagacaaagggcagctaatggaagcctctgtggaggatgaggagggagaaaccaggagtgaggaataagcaaatggggcccagtctaaggtctaagccattatggccatgtgggaatgagggtcctgcatggcccttgtgacttttcaaaagatacctaaatctgggtatttatgtgaaattctcaattacttaaatgttgacaatgcacttaaaaaatttttgaaaatcactatactgactggttaaaaaaaataaaggtaaccaacacacacacagacacacacatacacacacacacacactttgaaaacagtctttgaaaacagtaaagtgttctgcaatctctaagtgtctagaaactctgcagctgcagtctctttaagatctgcctgagcatcacatacccttaaacagattttctacccagggaggtaaagtttcatggatctgccaagacacggactgattaattaattattccatttatttaacaaaaatgtattgagcactaatatgtgccaggcacatttatagatcctggagagacagacttggagttgctacagcaaaatgccataaactgagtggcttaaaaacaacaaaaatttatttctcacatttctggaggctaagaagtccaggaccaaggcatcagctgatgtgatgctggggaggtgggggacctgctttctggtttgtagatggcacattctcattgcgtcctcacatagtcgaagggggaagggagctctctcggggcctcttacttataagggcattaatcccatccatgaaaactctgccctcatggctaatcacttcccaaagacttcatctcctaataccatcacattgaaggttaggatttcaacatttgaactctgaggaacacaggcattcagaccacagcagtaaggataggaatatacttttgtgaccccttccctgagtacctagccggtgttaagcacatagtaggtactcaagggatccacatggaaatggcttctcttctcagagtcctggtccatataaagtcaacaacccttttaaaaaaataactgaaaacagaggatcagaaagtggttaaaataatgaggagtggtgggaaaaatcaagacatcttctagtcccagctctgctcttgtgtctttgagattgttgcttctcctctctcagcttcaggttcccgattggtcaaaggagagttgggctatgtgacccctgggggaccttcctgggatgattgtctcccatgccagaacttgaagccaaggtttttgactcccacctcccactgtagctgtgcatctgagctcccctgttacattctgtcaggtgttactggtttgtaagaatcacgattactcattattgggtacttgctgagtgccagatgcttgcaaaaggcatttcaacatgatctcatagcatcctcaccccaaacccctgtaaagtagctacttctcttgggctgggttccctagaagtggaggctaaagtagggatttgcaagccagtgactcatggagggagtcctcttcaggaaaactgtgaggggtgacggtggtagctcaaggaaggggaagaagccaaggagggatattgtcttagagaagctctggccttggcctggtctacaggggggctctggggcaaaaacagtgccatggagttgtcccactttgaggaaagagcgctgggcttctgtatccccaagagcaatcagtcactgaccccctggtgggtggtggtggagagggtttaccctctcagccgtctcagggatgcagttaccatcagcccaagaaatggagaaggccacgggtacagcattaccatgacacctggagccgctgggggcactggctggcaaagaggatgtgagcagagaactgaccagcatttacactccactattactagcccattttgcagatgaggataactgaaacctggagtagttaatatgttcctaagaactactaaatacagaggtctgaactgttaggtacaagttgcgcgtctcgtaaacagccctcgccactgaaggacagggcccatgtctgaaatgcctgtttccccagcacccagcatggcaattgcacccaggggctgctgagatgtgcttggaaaggctgagtttgtgagctgcagctcgccagggcaatggggcctcaagtggcatgtcgccgggaggcagaggggttagccctcacccacgtggtggcctggggcagccctgctctccgacagctgcctgagctccagcgctgtcagcagcctgctcagcgctggggcgggcctcctgccaggctgctgctcggggaaggggaacattattcatcggagagataaggcagctgatgagagatgggcctcagagcagctgttcctcggcagcggctggaacggatgctggggcagtggagtggaggagagaggagtgggggaaggggaaagcccattttgagatgaaaaatgatggtactgccgaggggtgatgggagagcacatttcaaacccaggccaggcgctaatatgtacttatacccaaggccttccccacacatatctctgtctgacaggccacatctgtgctctgtcgggttaactattgaactagtcagagggctcacttatcagctcgctcagcaggaaatatctgcctggtagggcaccccctcccaagctgcttcctcagtgcaagactgagaagctgggcccaaaagatgctaaacgctcctgcctgggccacagccctaaatcacccatctccgcccccagagcacccaggtggcgctgatctcaggtggcccagccacttctcgctggttccctaggttctccatcttccctcaaagctagctgacacaggatggaattttccaggttgaggggcaagagtgggtgagctttctttattttatccattgtttgatagttgtttttttttaaaggaaagatgtgaaaaaggaaccttgaggccgggcacagtggctcacgcctgtaatcccagcattttgggaggccgagtagggcagatcacctgaggtcaggagttcgagaccagcctggccaatatggtgaaaccccgtctctactaaaaatacaaaaattagctgggcatggtggcatgtgcctgtagtcccagctattcggagactgaggcaggggaatcacttgaacctaagaggcagaggctgcagtgagccgagatcatgccactgcactccagcctggcgacagagcgagactctgtctcaaaaaaaaaaaaaaaggaacctcgagggtttcctgggagacaggggagggcaggatgtgacgtctgtctgtgacgggacctgggctgtcaggtgaaacgcctgatggtcttccctgacaagctgcggctgcctctccagcctcctcccctgcccatcggtcaggtcatcttcctttctgaccacatcagagggtttcctcagaagccagggccttccctgtccctatgttctaacatggactttcccactctgaccgcctggctaacattttgtctgtcatcagtgcagggaagggtgtagacaggagtccttaaaagtacctatggtattatatttcttttcattaaaaaaaatctaaaacaaattcggctaaatgttaagatttgacaaactcagttgtgaacataagggaaacaacagttagcatttaagagtgctgggaacttgtatttttcagagtattaccttaattgatcctgacagttgccctttgaagtgtgtgtttaaacgagacagaggcacagagaggacaagcagcctctccaatgtcacacggcagatgcaagtagcctggctccagagcgggtgtcttaaccaccttagtttatgagtgtttgctaaattattctctgtactttttctagccttaaaatagttcagaattttttttttttttaggatctgaagcaaacatggcaaaatgttaatatttgtcaaagtagtgtgttcaactatctatgtgtaagattattccgaactttgcaatatgtatatgaatatttaaaaagaaaacaataaaaaagcctcagcgctattaccacttctcctcagaaggcttctgaagtccccccgccccccaaccagctcctctaagcccttgcttctctgaactattctccaccaggccctgactgtgtcacatcctagcagttgatttacttcccatttccccctccaggctgtgaactccaccagcgagtggtgatgttgaatttatatctgaatttccagggtctggccaattgcaaggaatctagaagctcaataaaattatgaaactaaagggagctatttagggggcccccatgggtgagtattgagcagctacataaagaggctgcagagggtgcagggaacaaatgtggaccctgccctccctgctggagacatatggcagtaatttttaggaccataacccagtaagggcttccagcataaatgcttccagctgcaccctccactgtggacaggaaactgggaacctcttaagacaggatcttgatggcttccagctcagtcggatgcccatcaaaagaagcagagggtaggagcagctttctagaaagccctctgggttttacccactgtgtctggggctgtgtgtgtttactggtttggcagctgtcagatcaaccctcctcattctagtttagtggctcgccaatcttggctgtacattggaatcacccaaggagctctcaaaactagttcttcctcctcttctctgcccctagatattctgatagaattgacctgaagtgcccacctgggtttggagatttttagaagctttctaagtaattggaatgtgcagccaaggctgagaactcctgttaggttctcttttttaaaaaaagatagctgctaccaggtgaactgtgatgatatctccattcagtgcacatttactgagcatctattatgtgaaatgcaccaaggaaggaaagggtttgagattcctgtcctatggcgtagctaagtttgatgaggggaataagttggcaagttttggtgtgtacagatccaacagccggcctcagagtggtagtagaatcttggtatctcctaagcccacatcagacatcactgattacagtataatttcctgctgagtccatagtggtggccaatcaatggctgctggacaagaaagcaaggtggtaacaacacttaggtatgtttcctcaagttctagctgggacttattctttcccctgctaggtgggacttcatatactcataccagccaagaaacacgtcagcatgcagctaccatgtaaaacaaagtctggccgaacctgggaaacgtttctaagctaacacatttcccaacaaatacacacctaacaaatttctaaaactgctggagcatgaactaccctttgagaactactggttaaggccaacactggctaagcacacaagagctcatttaattcttccaatagccccaggggtcaattgattgcatgtttagagcacagactttgggttcaagccccagttctaccactaaacaactgtgggatcccaggaacactagttaacagttccatgcctcagtttacccatctttcaaaaagagaatggtaacaataacatgtacttcagagtgttgctaagaggatcacataagccaatccacataaagaattgaggcaataaacttcagatgtttttctatgaccttggatttcaaagtctcctgtatactgttctaacttgtttttcttcaaagtagcatatcttcaaaatcatttcgtggccgggtgcggtggctcactcctgtaacccccagaactttggtaggccaaggcgggcggatcacgaggtcaggagacagaccatcctggccaacatggtgaaatcctgtctttactaaaaatacaaaaattagctgggtgtggtggcacgtgcctgtaatttcagctactcaagaggctgaggcaggagaatagcttgaaccagggagtcggaagttgcagtgagccaagatcacgccactgcactccagcctggcgacagagcgagactgtctcaaaaaaaagaaaagaaaagaaaatcatttcatatcagtacaaatggagatgcttctttatttataattgtatctcattatgtggctcgaccgtaatttatttaaccagttccctacagatggacagttaggttgtttctaagctttagctattaacaaacacttccgagaatgaaactaatcttaacacttacatagtgtataatttcaattgcctgccactaattttgaatggaatgtcatgtataaaagcattcataagaattttatgcaccatggagttgggtgcaaaaaaaaaaaagacttttgacagtatctgcttatatcttctgaatatgaagatgattttggctgcaaataacagtgatgactaaatcaataaagaaaatgcatgagctcatatcactgagctagggcaatcacagggccgagtaaatcagaggctcaatgtcagactcaaggatctaaatgttttgtgtccttctgactcttgttctcaaggatggacttttgttctcatactgttccttcacgttatcagtgagccaccctggtgccccgggccataccctcatgcctatgaaaaagagtctctttcttgtgtcgcttttaagaagcatggtggatgttccagaatcctcccggcaggtacatctcaggcctccctggtcagaactgcatcatcttccctttcctttttttttttgagatagagtctcgctctgttgcccaggctggaatgcagtggcacgatctcagctcaccacaatctccacctcctgggttcaatcgattctcctgcctcagcctcccgagtagctgggactacaggcgcccaccaccatgcccagctaatttttgtattcttagtagagatggggtttcaccatgttggctgggctggtctggaactcctgacttaaggtgatccgcccacctctgcctcccaaagtgctgggattacaggcatgagccactgcaccaggcccatattcccttttctaaacacctttcccagtgggaacagaatgaccacagctggctgaaacgaaccaggattcacctcatggcaccagaaaggggcctatgtttccttgaagcacatggccaccaaacagctgaataaactcaggatttggcaagcatgaaagaaggcgggcaaccaacagtagacagcacaccttccgaaacctttattttcatggacagccatatgttgttcttgtaaagaactggctcataagcttgtgtgttttaaagaacaatattgctaagtgtgtttacaatgacacacatgggtaaattttaaaaatgcaatagtaactcttaaaatctgctacaagactttaatgaggtctggcaaccccttgacctggaatcagaacacataagcttgagaactcagtcacttctgcgaggtcgtgagaatgtttctctagctctccaagccttgcgtttctccctgtgaaaatggcagcttcgaggagaattaggggtcatgcataaaggaaaagagaaggggctttgcagttagacctggcttaggatcccggctcccccagctgtgcgactctggacacgttttgagcttcagtttcctcatcggtaaaaaggggataaaaatgtgcaattcatagagccatttaaaaatatatactttataaaggcatgatttgcataaaataaaatgcacccatttgaaacgtagtttgatttgcttcgacatatgtaacactaatataatcatcatgccaaataaaagatatactttcatcaccttcacaggtgacttgtgtccctctactgtcaatcccctgccccttattcccttggccctgggcaaccactgatgtttcagtgactatggattagttttgcctgttctagaatttcatgtcagtggaatcatgaaatgtgtactcttttgtctctagtctttttttcctcaacataatggctttgagatttgtctgcatagttacgtgctgccaagtatggactggaaggcagcccgcaggaccctgcctctcatgttcaagcccttacatgcttctcccccggagggggtgggatctgtgactggtttgctgaatacggcaaaggagatgggttggcaccccatgataatgctacgtcagataagtctcagtcttgctcccagatgtattcttgttctcccttgctttgaagtaacaagctgccatgttatagaaagacccatggaaaggcccacatgactcatgcttgtaatcccagtactttgggaggtcaaggtgggaggatcgcttgagttcaggagttcaagaccagcctgggcaacatagtgagacctcatctctaccaaaaataaacaatattatccgggcatggtgatgcacatctgtagtcccagctacttgggaggctgaggtgggaggatcacttgagcccaagagtttgaggctgctgcaagctatgatcactccactgcacttcagcctaggcaacagcgagaccgtgtctcagaaaagaaaaaaaaaaaagaactgtgtgcaacttcccgctgataaccagcaagaagccaaggcccttaatctcacagtcacaagaaaaatgacttgtgccaacaacccaagcgagcttggaagtggttccattgccagttgagcttccagataagaactgagccccagatgacaatcttgatgtcagtcttacagaagactcagctaagccatgcccagcccctggcccccacaaactgtgagataataaatatgtgttgtttgaagctgataagtttgtagacaactaatatacatctcttagtagtttgttcccttttatccccaagaagcattcccttatgtgcatgtaccacattttgtttattgttcacgagttgacaggcatttgggttgtctccagattggggctatgatgaataaagttgctatgaagattcttataaaagtcatttagataacatatttcatttttcttggggaaaggtctagaggagaatggttggctcatacggtgcctatatatttaactttataaggaactgccaaactattttccaaagaggctgcaccacgtcacatccccaccagcaatgtaggaaagttagttattccacagcctcaacgacagtttgtactgtcagtctttttaattcaatacctcattatagtttttatttttatttccctgatgattaatgatgtttaatatcatttcacatgcttgttggctatttttggatatctgcttctgtcgagtggctatttgagtctcaagatattaccatccctagggatgttttaggaaagcatatgtatgtaacatgactggcatttagtagacactaaataagatataactattattctagatgttattatttttaaggtcacttagagataaagttatatgattccataaagggcccacacagtatgctttaagaatctgttctaactcatgttctcttggggaaaagtctagcaggggaatgattggatcatatagtgcctatatatgtaactttataagaaactgccaaactattttccaaaggggctgtaccacgttacatccccaacagcaatgtaggagggttacagttactctacagcctcgctgacagattcgactgtcagtctttttaatttgacatctcattataatttgtattttcattttcctgatgatcagtgatgtttaacagaggagaaggagaaggaagaaaaaggttaaataacagaggaggtgaagcaggaatgcaagacgcccccaggatttgagatggaagacttcatgggcaggaggtacaggtcatgcatctcaaatctgaaaacctgaaatctgaaatgctccaaaattcaaaacttttggagcactgacatgacactcaatggaaatggtcactggagcattctggatttttttcattagggttgctcaactgctaaggataatgcaaatattccaaaatctgaaatcaaaaacccttctggtctcaagcatttcagatgagggatacttgatctctattgcccagtttaagggatgatgagttctgccttagccacattgaggttgaagggaaagctggccctctaatcggtctcatcactgggcctcaaagtagggtgagtgctgaggagcccaactttgccagacatggcatcccaaaggtgccaaacacctctatttaaagcagcagagatctcaagcattttgttacaatctgaagtctattagtgcctgtgtcagccctgcagtcactggggtggaggccgcaggacagagctaaacatgtgcaaaaggagtgtagggatcttggaataactctctatcaggaaggctaaaattagctcatctccctcctcaccactcctcttgccccaactataattactcacctttgcccccagctccattcctgggttctaaacactcttgcttcaggggggctttggaagggtttgctttctaaagcttccggaatggggtaagggtagaatgagcttctcagggcccaagttttcctccacaaggaaaaaaaaaaaacaaaaaaccttttataggaatttttctgttaataaatgtgacatgtgcttatttaaagaaaataaaatcaaatagcacagcaaggtataaagaagaggataaacgcagtagtcccaggatgtaaagataatgtttacacgtcaatgtgttccctctcatattttcagtatgtaaacaaatcaacgcatatatttgtaaataaaatagaattatacatatatgccattctgtaatctttttaaaactgactgtatccagggatctttgcatgccaaaatataaacttttagatctttttattgagtatctagtatttcacagttgttgggcatttagattttaaaaaatatattacaaagacttctggggaaaatgcctttatatctttttggattttcctaactttttatcaaaagtcattagtagggaatttacttactgaatcaaaggctttgaatgtataaaggtatgttgttctctcagaatatttgtattaatttccatgtttatcaatactttactagatggccagtttcacctactctgagcaacattaaattgatctttaatttttttttatcctaaaaaaaaatttcgtggtttcctccatttgttcttgggtaattattgagatttagctgctttttttttttttttttttttttgagacagggttattactctgttgccaaagctggagtacagtggaaaaaatatagctcactacagactcaaccttccaggctcaagcaatcctctcacctcggcctcccaagcagctgggactacaggtgtgtgctacctttcctggctaatttgtgtatcttttatagagcattttcccatgctgcccaggctggtctcaaactcctgggctcaagcagtcctcccaccatagcctccccaaatgctggggttacaggtttgagccactgtgcctggcctgatttagcaccttttttttatttgagacagagtctcgctctgtcaccaaggctggagtgcagtggcatgatcttggctcattgcaagctccgcctcccgggttcacaccattctcctgcctcagcctcccaagtagctgggactacaggcgcatgccaccacgcctggctaagtttttgtatttttagtagagacagggtttcaccgtgttagccaggatggtcttgatctcctgacctcgtgatctgcccgcctcggcctcccaaagtgctgggattacaggtgtgagccaccgcgcccggccgatttagcacatttttaacctgttttttcacacgccacttcttcttttgggcaagttgcctgtttatatctactgcttatttttagattagaatatccatcttcattgatttataataactatatatatagagagagagagagcttcccttgtgtctcctgggatggatgctcatttggctggcactgcacctccctactagcgtgtcctcttggactgcaaaggatgcaatggtaaaaacttcatttcctagacccccttgcagctgggagcctaacaataccagattcagccaactggaagcacttgctggactctgggaggcagaactgagaccacaatcacctcccacctctttggctgttccctgcatgcagacaagttcctgaagacctaactgcatgggattgtgatttctgtccagggccctgctccagtttcttaggtaccaacgaggagctgaggtggcagcagcttccagactttgctttctgaatcccagctatggcagagggctcttgaattgacacgttggccatctgggggggtcaattttgcagggctcagaagcttcctggaggccacttctccagtccttttgatgacattctcgaaacctaaagccacgtcttaagcacctttctgcataaaatccctacaacactttctgttgcttgtgctgagccctgatggatttttctgatacttcccatggcttctgaatcctgtcacttctttgtactttcccaggtcttcccacatcccactccagccactgagtgattccctcttctctgtaaggaggtctgaagagcgctcagcattctctgaggatttatagaattcttcacatccagatttctttgcaaatgataatagtggaaaccaatgagcttgccatccgacttcggttcatatcctggaccagccattcctgcttaagcaaggtgcttaaactgtgcctcagtttgcttatctgtaaaaattacaccatagcgatggcaatgcctaatatacggacctgttttcagggccacgcacaccaaggcaggcagcaggtgctcaatacatacttccgtataactcattcagcccccttttcctgtcttaatgtgactctaagaaagctactaagccctctgagcctcagcttccttccttaatactaggaaccttaataccttcctcacagaactgctgtgaggaccagaggaaatcagacaattggaagtaaattccaggtctatataaaaggtattatttggagaccaggtattgtttcaagattcctttttagctaataataataataataataataataataaaaagctggctgggcgcatagctcatacctgtaatcctagcactttgggagaccgaggcgggcggatcatgaggtcaggagttcaaaaccagcctggccagaatggtgaaaccccatctctaataaaataatacaaaaaattagccaggcatggtggcacacgcctgtaatcccagctactcaggtggctgaggcaggagaagtgcttgaacccgggaggctgaggttgcagtgagctgagatcacgccactgcactccagcctgagcaacagagtgagactccatctcaaaaaataaaaataaaaaataaaaaagccaccctgtgcacagtcattgtcttattcaacaaatacacgctctgcacctattctaggcagtgtgctgggagctgaggatacagaggttaatgggatagacgtgatccttggttttgtaggatagtgtgggaacagacaaaacccaaaacctatgtaaacacatacatgctattacaaattgtgatgagtgctgtgaaggaaacgagactctaagtagtaaaaaccagacactggtaccagcatgggagagagagatgtatttctgatccttgaaagtatagtattggagagatctattttaaagaggtgatctaggaattcaattctgctaggtggacatataaactggataccacagccacccacagccccagaatcacctcccacccatctcccatctccagtcttctgctgtaggtcttagcaagggagaggatgaagagttctttgtccctgggttatcagggaggctgcatgaatgccagtttgctgaagcctggagattatctgggggaagctacctatttctggggtaggctaggtgaatgagtgaattgtaaaaacttagagaagtgaatttaagggaaaaagagaggagaagcttagagaatatgagaatcaggaccataaagagaagcttgggagaagaagaaaccaggaaatgcccaagaattctgatagtctggaatctatttctggaccctataaaattaaaaagatgggccctgcttcctctggaggcaacatggtagaatagaaagaatctgaatcagggtcagcttgcctgggttctagtctcgctctcacttttatgaccaggggcccaacactctgacccttcttcatctgcacttcctccatttgcgtatgagaataatcaatgtttgctctgcccccctcccaggacttatccattcactccattcctcaactatacattgggattaattggatacctggcactgccgtaggcactgggctgtggagatgcatgagacacattctttgctgtcacggagctcatggagccctggaagagactcacatagacagagacattgccaacatggtaaggaaaatggtgaggacaccacaggaacagagaaaggagcctttgtcagttgacacagtaacaggggcccaggatattgtctcctgcaggagtcaacccttcagtagagtcttaaaaatcagtagagtttggcagtaagtggagattaggaattaaggaactccaataagagaacacttgcataagcactttgtagctgagtgactgtccacgtgtggggaaggagcattttcactccagagtctggtaagacctgagcaaacccaactggtccacacctccacatgctgtatatgctattcctttggaatagaatgccctcctctattttgtctgcttggaaaatacccactcatccttccagttggcttcaatatccccttcttcgcaaagaaagccttctttgaacatggcagtgagctggcctgtcccttgctgggcttcactgtatcacatacattcctctctcatggccctcagtccttcaacagtgcacatttgtttcacaacttggttttccaccaagctgtgagctcatcaagagcacagatgatggtaccttctttcttgcaatgttatcacagcctatactatgacaatcagacagtggacactcaataagcattggtccaactggatcgagtcttgttctagggtagacaagatcctgggaccctgttactggcctacttgtgtgtcatttatcctctgaaagtcttcaccttgtaatacttatgtcttctacgcaataaactgagagcaagggcctggtgaatcactgctaagaaacagaaattggagaactgtggagtaaaggcttcagtcaccaaattgtagcctagagaataaaatgtccttctcttttacatattatagaagaagaaaacagtcaagggtcctaattctgttcctactactgattctgtgactttgcacaggctgctctgataaatgctgtgggttggctaacccaacaactacaaccttcctctcttttgtctctttctattgcagagggtggaaatccagatattcaatcttgccaggctcccttgtagctagtgctagtgacacgtgacccaattctggtcaatgaggccaacacagaaatctgctaaggacttctggcaaagtgtcttaaaggaggaggcctgagaggagaagagccaccaggcacgaccccgtcatcctgacctgacattgacatgatgcctccacctgtggcagtcaagttgggacagcaagatggttcatcttatgtgtcaacttgactgggctacaggtgtttaaacatctgattaaacgttattctgggtatgactgtaagggtgtttctggatgagatttgcatttggatctatagactgagtaacacaggttgcctgagccattgtgggtgggcttcatcagatctgctggaggcctgcatagaataaaaagctgagtaagggagaattcgctctccctgcctgcctgttgaagtaggagttgtgagtaggaggataatgccaatatttcaggtttctagaaatgtaaatgatccatagtataaacctccaccaacatgtaagaagaggcagatgaaaaatattgaagcatcgttagcatgaaaatagcggaccattcagccgtagtttacatctcagctgatatgagtgactgaagagaaggcagttgaagtgtctgatgtgtagtgcatggctaagaataatcctgtaatgatctgaaggattaggcaggcaccaaggagtgagccgaagtttcatcatatggaaatgttagatagtgtgggaaatcagtgaatgagtaattaataatttttattagcaggtgtgttgaaaactaggacatcagtctcctcctgactctggacttagactgggactcacaccattggctctcctgggtcaccagcttgccaacagcagatcctggaattctcagattccataatccagtgagccaattccttatagtaaatctgtagctatacttgcatgtacatctatctatctatttatctatcatctactattggttctgtttctctgaagaactcagactaatacagacagtatagtattgagcatgataacaaaatgccaataatctaagaatgacaggaaagaatggcaaagagtgacctgatccttgacagcaaacctctcattgcaccaaatctggaaacacctagactcttgctatgtgagaaaaagaaatgtctttattgcctatgcctctacatgtcaggttttctgttacttgcagctaaaagcattcctgacgcatgcaattatctcccatctctaagccttatttctcgggttacacaatggccttaaatgaaaccgacaaacatttccaagtgtctcttagatgcacggctctgagtgaggggttcaaagggagccagcagagtagagcttaagagtaggaactctggggctaggctgctcggcttagaagcccaggttcaccaacccagcctgttatttaacctctctgtgtataagaagggtcatactagtactattaatattaatagggttgttgggaagattgaattagttaatccacgtaaggcccttagaatagtgctcagcacatagaaaaatgctcaataaatgctaattatagctaagaactagacataggtcaagccttctgggagtttagagtctagctttcaagtcaagaaatatacacacacatataaatatgatattgaaactataaagatatacatgtataattgaaaacagaatcatttaacttcttaaattctaaagtaaacttagcctgtaatcccagcactttgggatgctgggtgggaggatcacatgaggtcagcagttcgagagcagcctggccaacatggtgaaaccccgactctactgaaaaaatacaaaaattagctgggcatggtggcatgcgctgtagtcccagctactcgggaggctgaggcaggagaatcacttgaacccaggtggcagaggctgcagtgagttgaggttgcgccactgcactccagcctgggcaacagagtaagactctgtctcaaaatataaaaataaataaggtaaacttagcagctcattatcataagacataaaggctaaaaacttaactgcctccagagaagacttagataaataggcagatgataaaactataataatatgttagtcaaagaaagtaggcattttgaggctagcctcagaatttgaaattaattagaaccaaataaaataggaaaagataacatttcatagtgttttatagcttttaaagcattttcatgaaatctaacaactttgtgaagaaagggtaaacgtgaaattttttccatatgtgatctcattttggctgtcaccttgttcgaagatgtgtgtaattctccttttacagttgaaaggccatgggcttatggtgaggcttacctgagatgatacaagtgaacacagtctctaacttttcttaaacaactccaaaaaatgcaagacattcaccaagtggtggcttagaagtcacgtattccccagtgatgtttggtaacctatgcccctgtccccaccctggtctccagaaaaggactttaacctacgtctctctctctgaggccttgagctgcaggaactcttacatagaggactctttctggctccctttgagtctctaaagttaccgtcccctggggccaagtaggttgtgaaggacctgctcctgactccaccccagccacctgccctaccgctgagcacctgaggcctctctagaatgtgagtacctggacccggcgcccatgggtgtaagataagagtgccggcagacctgttgttttcttctaggaagtctcagattctggaagcatgactctctctctaatctcctgagagctaaggcccacacttagggagccccacacatccaaggaggtgctttaagagctgggctgctctcttggatgctgcgtgcagctcatccctgcctgggaactgggtccttgccttcctgaagcagattctcagtcatgacaatcactgttacacacagagggggttcccaggatgcccaatgggcaggcactgtaaatctgcttccccgccggcctcccatcctgcagagaaggcagccgtggagtcagacctggattcagagggttaagaacacagggtctatagctagatgatctaggttcagatcctgactcagccacttcttagctttatcacctcaggcaagttactttcatggtctgtgactcagattccttgtggaaaatgaagatcataatagcgcttacctcacagagttgttaagaggatttaagtgagttaaagaaaaaaatgcctggcatgtagtgagcgcatgatgaattttagctattttatttgttttgtgatttttgagcaagtctttttatatatatttttttattttagggacagggtcttgctgtgttacccaggctggagtgcagtggtgcgatcacagcttgctgcagccttgaactcctgggctcaagtgatcctcccacctcagcctcccaagtagctaggactacaggcatgggccaccacactcagctattgttttttgtttgtttgtttgtttttgagacagagtttcgctcttgttgcccaggctggagtgcaatggtgcaatcttggctcactgcaacctccacctcccggcttcaagcgattctcctgcctcagcttccagagtagctgagattacaggtgtgcgtcaccacatccggctaatttttgtatttttagtagagacggagtttcaccatgttggtcaggcgggtctcgaactcctgacctcatgatctgccagccttggcctcccaaagtgctgggattacaggctgagccactgcgcccggccccagctattgtttttattttttgtagagacggggtttcactatgttgcccaggcttaagcaagtctttaacgtatctgaaccccagtttccttgtctatgtaagggggatgattacatgtgcccagagttcactctcctttctcccgttggtaatcacatcacacttgtagctactcatctgttgtccacctatctgcatacatctgcagcaaggcactgtgcccatttacttccagctcccaaggcttagtagagggcttgacacataggtgctcctaaatattcatcaaatgaagaaatggcactgttgtcaggattgaatgaaacaaagatagccagtctgatagaaaaaacagtggaatccctatatacatatatgcatgtgtgtgcatgtcttggggagggaggaatttggaccattgagaaatgggctggtgtcctaacttagtccttatgacctgtgtgactgtaggcaagtagctgacctctctgagtttccatgtcctcagctataaaatgagatggtgggctgggcgcggtggctcacgcctgtaatcccaacactttgggaggccgaggcgggtggatcacgaggtcaggagaccgagaccatcctagccaacatggtgaaaccccatctctactaaaaatacaaaaaattagctggatgtggtggcgtgtgcctgtaatcccagctactcaggaggctgaggcaggagaatcgcttgaaccaggaagtcggaggttgctgtgagctgagattgtgccactgcactccagcttggcgacagagtgagactctgtctcaaaaacaaaacaaaacaaaacaacgaaaaaaatgagatggtagattgacctgattaggaagattaaccaaggtaagttatggtcggcatcaagtactgtgcctgaatcctagcgggtggttcacaaacggcagctcccttccccacttttctgatgcctatggactgagccagtgcacaatgaaaatggcaataatgaacacatattgagcacttactatacacagggcactgtgctaagaacttagcttatattatctacagtgcagtggttttgaaatggggtttaggagaagaaatccttttgtaagcaggagtgggactggggaacggaggcgttaatcaagtgagactttcatacaactgagaaaaggttaacttccccctaaagaaggagcgtgtgtgcagggaatgaggggttggtccatgatggaggttatgggcccaccagtggcctctatatggctttatctagagcatttctgaattcatccacttaaaatttaattaggaaaaagggttattctgcttaaaattaaattagcttggaaacaccacatataataaggcctggagttaaaatgctgggttcttgtcctggccctgaaactcactagccagaaaccctgaacaagtcaatttccctcttttgagccttcgttcttttacagttaaaacaaggaagtcggccgggcgcggtggctcacgcctgtaatcccagcactttgggaggccgaggcgggtggatcatgaggtcaggagatcgagaccatcctggctaacaaggtgaaaccccgtctctactaaaaatataaaaaattagccgggcgcggtggcgggcgcctgtagtcccagctactcgggaggctgaggcaggagaatggcgtgaacccgggaggcggagcttgcggtgagccgagattgcgccactgcagtccgcagtccggcctgggcgacagagcgagactccgtctcaaaaaaaaaaaaaaaaaaaacaaggaagtcagatggtatacttctggggcctttattagctaaaatattctgagagagcgtgaccttctagtactgtctcccatggaactgtcctggtgaaacccagagatcagctcatgaagatggacttgaggcaagagagagctgaaatgaaattgggcttgagttgccactcagcccagcaccatcttttcagatccttgttctgaagcagcagatcctcttcatcttttcagccctgaaggaatcccttacatccgggtcactgcaaagttccgggcaaatttcctgacaaacttctgttcattttttaaaacccattgtaaatgttatggtcatttgttcattcaataaacatttattgaataaatactctgtgccaggtgttcttctaagggatttggcagtgaacaacaaaaacaacaaaaatccatgccttctatattttaagagacatccttttttgaccaactagccttttgcatagactttgatagttttactgttctaagtgacatgtcggcttccctattagactgtaagctctatgaggccaagaactgtatatactcctcacttcatccccagtttcccaatggaatacctggcagactgcctgtatttttctcttcctgaggatttaaagacctggacatgtatactatggtcattatctcaccatcctagccaggaaattgacatttatttagcatttttttctgggaagacttactgcctagtactttcctacttatattctaagatggcacatttaattatttgatcaatatctgccccttgtccattagactatcagctacatgacggcagcggaaatatttggtttactgatgcagcaacagcatccaatagatgtatctagcatacaggtagcactcataaatgtttgctgaatgagtgttaggatatggagaggaaaatgtggtgatgcaaaattatgcaatttgcagtctttaatgctgatcagtctagctgggtactgggagcacacagatggtgtatgcttaaaagcttatgaataggagttggcattttaatacagtaacaagtacttgaacattgactaatacacagttgcgtgtgacaaagtgccacatttctggtatagataagtgctggaaaacaggctttggagccagtgagatctgagttcaaatcttaattgtgcttcttagaggctgggttgttgggtgatacttaatccacctgaacatcagtttcctcactgggacatgagcactgaattagcaagtatatagtacagtgtctggcttttagttgatgctacataaatgttagtgcttcttacttcttgccactaaagagaatcttgtccctcctttcaggcccaagtccaattccttatcttggtgaacccttccctcactgcacagctcacagtcatcctgcttgtcttggagctcctctcataatgatcagccaagcatcctgcttcacatatttagctttctatttatcaaatactttcaatgtgcctaatatgcaccatagcctcgtgtagatgttttacaggttttagtttcttaatccccaggacaaccctccgaagtcggttcccattttacagatgaggaaaatggcaccagtgagatgtcactaacttgcccgagggcacacaactgggaagcagtcctgccagtatttaaatccaggcagtctagctgcagatgctgcatttggaaacccaagggccacatggcctttctgccttacgatgtcaaccaatcatggtttgagctgggccagccttgctggctggagctgaagctactgaaggggaggacagcccagctcctgcctcccagcatctctgttcttctgaggagagcagagcccctcttggaaagggcccattccaaggtctcaaagatttctctatgagatctgggaggctgcacagctttgttgggcacatgagaatggaaccagaagacccccaactctacacccaattcctcaccatggaaaggaagtggaggcaccttccaggcagccccctaggtggcggctgttcccaacacacatttatttagcatgagcctagggcttggttctggggataaattcttaagcaagacaatatgaaacaactgaaataatttgaaacaatatgatgagcttaaaatccatgcagtccccaaattccaggctggtctgggtcaagggagaatgtagtcagtgagggtttctaagcacaagtgagcagtaacaaggaatcaggaagatgggtgtgagttggccatgccaaagatattttctggagctgggatggcaacatgggtattccaggcaagactggccaatacctccaaggtctgaagatagaggaagccatttgaaataccttctccattcaatctctgcaatcttgtgaaaaattcattggttttttattagcctatttttcagatgggaaaattgaggcccaggttgtaccttgcttatgatcaccttgctaataaatggtagagctgttcactccaaagcattcacaccagcttctgagaatagaggcttttataaaacaagcaaatgcaaggaggatgggactcgtgggcaggttcatgggactaggttctaactgaagatgtggtaccgtcactgaccatgggaaaattactggaactttctgagctcctttttccacatctgttggcaaatagagaagatctgaatatgtctcaagtcagagtttgcaaaacagtatgctgcattaagcataacccctggagacaaaaaaaaaaaaaaaagttggtggtcctggatgtattttactgaggaggacactgaggtttagagcagttaataactttcccagtttacatggctaaaatgtgacagtgccagaatttaaactacggtggtttggattcagaatcacagtcttaaaaaacacgctctctactgtttttcgagtacagagaaatgataattgatgctcagcccctatgtctgggatacattagggagtggtggggactctggtgagctatagagtccatgctctgactaaaggtacactcctgtgactgaccttgagtaagaccagtgaatgtttggtgccccaattttctctaccctaaaattgctataattatctcttcatctcatagggttgttttgaagactaaattaattaacatgcctggcacatagtaaacattatgtaagtgcaagctgttatgacctgtgaggtgatctttgttttacacattcgtttttttaaaaaatacccatctaacaagttctatgtcttaaacattcaaaacacctacttatatatagtacagggaactgcgcacaccactgacgatcaagttttgacaactgttctggggccttttcctcctccttctgagcaacactagagcttgtgggtagggggagggggcttgggaaaagaattgagctctccaggccacaagcatgcgcttcgcacatcagcagcagcctccatagctggctgctgtagcccctcacagagctcatggttaccatcggcctccaggctgtaaagaatgtgaggtgcaatgggcagccttccaggtacccaagaagggaggcttcatcctttcaggatgtctcaggcttcagataaaacccttcctgtgttccagctcatagctggcaggggcaatcggcaatgactgacgacaatgggtgacttgtcaaaaagatgtgtgtgtgaaccaaatgccagctagctggagcaaagcatgcattcaggaggctggtgggaagaccatcaactgcacaatggtttgttttgcacctactatgtattgggccccgggccaggcccagtacatagtagtacatacatttcaggaggtggtgaaattaataataatagtagttcacctgtatttactgcctcagagcaccacaacagacattatttctcttaatccttggcacaagtctatgatgtaagcaggcctcatttccttgctttaaaggtgggtaataaatgagacttgtttaaagttataaattatggcagagatatttggccaagcttgtttccttttccacctgggtatccccatctggactacatttcccagcaggccttgtggttgagtgtgggcatgtgacagagttctggccaatgggatgaatggaatgctagtgatactgcaatatggctctgcgaggcctggcccataaaaatctttccaagcagtctatcctctcctcctcccttggctagcagatgcagagagtctgcagagggctctgagtacctagcgatggtggagtcacaagatggaaggcgcctggttggattcctgaggaactctgaagaaggtcgtctgctgaatgccacactctactcttgattgagtgagacctaggcttcttttgtgttagaccaccaagttttttgtttttttttttcataacagatagcctgccctaatatacacagtaaaagcagaattggggttttagaggcattttgcttgtacatgtgacagttttttcgaccatcttccaaacaggcagaaaaatctccttatgcatatagagtcttgggattttataaagcatttgaacaagtaatgggacagtttcttccttccactccacgcaacacttggactgtggactcttgtccactgtgggaagctttcaggtggggtaagatgtctgggctagccacagctctggtatcatttgctcagcccttcgcaattgtcctggtagacaataaagtgtcagtgttgtaaggcattctttgcatgcaatgaattaacttccctcctgtccatggataatggtacaaattatataccgtccctcagagaactgtgaaaatagtcatcattatgtgcttttgtgttctgtggttcagatgagaacccccaattgcaagccccttcccctctctgagcttcagttttctcatctataaaaccacagggtggaattaagtgaactaaagagtctcttgcgagctcgaatttgctatactctcacaaaaaagcaatattttgtatgagtcagacactgtcccacattatttcacttagtcattgaaatgaaggaggatacaaataaggtattttggggaaaataatagagaaactggaattgcccaccttcagttgtttcctccaaagtttctattcaataaactttaggggagtggcaaagtggtacacagtattactctaacttgcaacttcactgagcctgcaatctaggtgggaggacaaaaaccacacttagggaaccaataaatgtcccagagcataaggcaaagagtctgcatggtcaggaagacaaagggggacagagggaaagagacctaccttggttgccaccctccaccctgcctcaaattcctgactgcagacacagttacgctctgagcacttgctgtgcgccagacactggctgggtgttttgctttcacactgcatttgattctcacaggcgcattgccaggagggcatgattctatctggttaaagaagtggagcttaggaggcacatggtcagtaagtcacttatccaaggctcccacatagctgataagtaccagagccacagggtttgaagcaggtctgtgtggctgcaagagcctgtattccctgcactctgcctctgccctcctatatgggcagctctggcctgagattcaagctgcactaacttccccgggtcttgaagaagagatactggcaccccctctaagggttcgtgccctttcattcatgaatcacagtcaggtatcctgaggaaacctcagcttgcagggcatcccatggcagagaggtcggacattcacagagaggtgcagcaggtttggtatcattggcagagccctggatattctaactgggaaactctggtacaaaaattccaaggtttgcacagctagaggcccatgggaaagacctaggagcagctgaaactaactgaccccacctggaagcagatcccctccaaggacacagagggaagaaaagcggcaggaagtagctggtctggttgttctcaggaaggcgcacgacctggaagagagaaacgtctttccctgcaaacaacgatctggcatttctcagtgtgtgctcctgggaccctctgcaacacagctcacttagcatgttgaaaaaggggattcttgggcctcaaacacaatgaatcaagatcccctggagtggggaacaggaacctgcatttagccaagctcatcagatagttctaatgctcaccaggatttaaaaatggaaaattccacttatttgaaatgattctacttagttcttccttagatgccctattcattcctgccattttgcccatcagtgatgcttaaccccaggggaaaaatagtaaatatattaatatctttttttaactttaagttctgggatacatgtgcagaatgtgcaggtttgttacataggtacacatgtgccatagtggtttgctgcacctatcaacccatcacctaggttttaagtcctgcatgcattaggcatttgtcctaatgctcaccctccccttgccccccaccccccgacaggcccgggtgtgtgatgttcccctccctgtgtccatgtgttcccattgttcaactcccactaatgaatgagaacatgaggtgtttggttttctcttcctgtgttagtttgctgagaatgatggcttccagcttcatccatgtccctacaaaggacatgaactcatcctcttttatggctgcatagtattccatggtgtatatgtgccacattttctttatccagtctatcattgatgggcatgtgggttggttcaaagtctttgctattatgaatagtgctgcaataaacatacatgtgcatgtgtctttataatagaatgatttataatcctttgggtgtatactcaatagtgggattgctgggtcaaatggtatttctggttctagatcattgaggaatcaccacactgtcttccacaatggttgaactaatttacattcccaccattaattaatagatatatttatatctattgtgtgctcatcatgtgtcccagattcctgtaagcattttaagtgaattaagtcatttaatatcctcacaacatccttctaaggaaggtactttcactagcctaggattacatataagggaactgaggcacagagaagctaagaagctgtgaaaagccacacagtaagtggctgggccagaacatggacccaggcagtctgattcccaagcttgacctctaaacccctacagcatgcaaacactgtgggaagatccatttattgaagactcactctgtgctaggccccatttccaggtactttcatgcattcaacagacattcagcaaatgcctactatgtgccaggaactgctctaagctctggccaggctgggaggtgagtgaagcactcaccttgggaactgaatctaaggtgggagtagggagccaaaaaattcactaatcaagggaaacaatattttagtgtaatattttttaaaaaatatcaaattaacaagctatggcccatgggctggctcacctgtttctgtaaatagttttattagagggaaataaaaaacaataaagaagaaaatactaaaaaccttgctctaatggagcttacgtaaatgacctcatccaattcttaccatacatggccccaaaaggctgctattgatatcattacagggtaacatacaccactctgtctatgggtaactaacgattatagaggctgacaattatggagtgccagacactatttttaagtgccttatagtattattttattccttgcaacctccctataagggaagatcattatcatccacattttacaaatggtgaaactaatgcacacagaagttttataatttgtccaatgtcaatgcagccagtaagggctggagctgggattttaacccagacaggcacactccaagaggccataccttttttcttttttttttttgagacagagtcgcactctgtcctccaggctggagtgcagtggcatgatcctggctcactgcaacctccgcctcccaggttcaagtgattgtcctgactcagcctcctgagtagctgggattataagtgcccactaccacgcctggctaatttttgtatttttagtagagatggggttttgccatgttggccaagctggtctcgaattcctgacctcaagtgatccgcccaccttggcctcccaaagtgctgagattacaggggtgagccaccacgcctagcctttttttttttttttttttttaagagatgaggtctctctgtatcacccaggctggggttcggtggtatggtcatagctcactgcaaccttttaactcctgggctcaagtgatcctcccacctcagcctcccaagtagctggaactacagatacactccacatctgacccaaggccatacctttaaccacagattggcaaattatagcccagaggtcctatctggcttatcacctgtttttgtaaataaagttttattaggacacagctatacttaatcatatgtgtactgtgtgtgtcatgccataatgatagagttaagtagcggtgacaggccacgtgggctgcaaagctgaaaacagattaggaccctgacctctagggtcaagggctaagcagtttaagctggttaatactatggatttagatggagaccattgagacactctaactaacttgggataagcagaacactaggtaaacagagaattaagacatcctaaaaaaccctaaacctatcaattaatttaggctgttagggcagattatcatagcaatgagaccccaagagaaagactggacattcccaagtaaggaccatctaattctttctttaggcttgataggcctcaccacaatatgatacactgaggttcgctcattcattcattcattcagtcaacatttacgaagccccttccctggactaggcggcatgctaaaccctgggaaagaaggacgcatgggcacccatgagggaggtacacagcaagatacagttgacaagtcatggtctttagagatacacctgggttcatactccacctctgttctcttctggctgtggacataactccactctctgagctttggtgttgaacattggatataacccagtggttaaaggcaggttaaatcccggttccttcacaaccattagctgtgtgaccctgagcaagtgactttgcctctctgaacctcagcttcctaatctgtgcgctagtttacttcagggacaggatctaggcaaagctgcccagcacaccgtaggcctcagtggatggctgcaattctttattacgatgatggagacagtttaggagagctgtctgcggaaagaccccaaatctattaggcatgttttatctttgctctcccagggtcttgaataaacaacgtcttcatccagtttttaaaagacactctaattctgtctcagaatatactgccacccccgcccccccaccccttacctcacccccagctgaaatttggccggctcagtgcctggctgctggcctgaatttccaaacactgttggtttagcatttctcaaatgtatcccattaacactatgaacctgtcagccttctctcctctttgagctcaagtccgaccatcacggcgagagacagagccagtagcatgagcccagcctcctagactcgcctttgtgaagcagtgcagttcccgggtcggtcggcctgggactgggggcacctgtcagcatttgcatgaagagtgtaccctagtcagacgcacatacaagcggtgtgctcggagactgcgagaaggcgcgttggaatgaggggctctgggaaatgcaagcaaaatacattctctgggttggcactggaggggaaaaaacaagaccttgaaggaggcttagcaaaaagccactgctctgggaaatcaggaaatagctctgccctggcacagtctccaactcactctgtgtgtcactgagcacgctacttgccctctctgtggcacgtttattttaaaatgaatgggttaggctagcccacgtgtttttaaactcttgtctggcagtggaactcttttctggaaacatttttacttggaattttaagatataaacagatgaaagtgtttataactaattctctgggttaaagagatgggggtggggagaggagagctggaattctgatcactcagcaccccgtacccccaaaaagctcaaagaaactaggaggcgcctctgtggaacagggttcgagaaccacatgacatgatggatgatctgtagaattcccccctgccctggcagccttggatcctggtagcctgctgataacagcaatggctattatttattgagtacgttctttgtgcaagggactggactttacttctgtgtcttttacttcaagagttagtagacagctctgattcagaccccagcttcaccaactgagcagctgtctgaccttggacgagttattcggttggtgcaaacgtaattgcgcttttgccattgaaagtaatggcaaaaatcacaattatgtttgcaccaactgaatagctaacctctcagtgcctcagattcttcatctggaaaataggtcgttcagaggattcaaggaattaatctctctaaatgtgcttagaacagtggcaggtacatagtaaacaattgatgctagccatttttatcatggctgcctagattttatctaacctttataagcaccattctatttcacaggtgaggaagctgaggctcagaggtgaagtgagtgaccttagatcacacagctagtaagtgatggagggagaacctgaatccaggtcagcttaactgcatggcttgtggtcttaacaccctgcctaaactgctttgctcttgacccaagaagtcacacacagacatagggtcatagcaatttgcacgaggagttccaagtctagatagaagagttgctaatgatgactatagtgatttatgcttataggagctctggtgtcagcagtctggggtctgggcatctttgcaaattcagatcccacacagaaaggaggtatttggttaacagagcccagggatatccaatgttctttcctgcaagccacgttctccagcctttcctactgacctataagacatctgtgcaaattagaaaaagggcaggggcagccccaagctagagcacaggtaagcagacatcaggctgattttcaatccccacttggaggacaccgtatgcctttgcgtggtgcacaagctgtgcaaccttatccagccatcttgactcttctcctgcctcagtgtttggtggagagagaataaacatggccagatgggagacaaagaatggtctcaaccttgccctgatgcctgtgggggcctgggatgggaggggggcagcaggagcatggaggcagcgcaggcaggaagcaaatgcaagccacacagtcactttatctctttatgtttctttctctcagctccgagggtggtaataaaagatggctgcacggctctccccgggaaactgaacgggagccaaaccatcatgtggtgaacaaatgctgtgatcgctcaactgcagagctgctgctgcaccgtattaaaaaggtgacagcctctcctctgacccttgaaccatggaaatgggcagccaccagcccacccactcagaaagccccaatgctctgtcaccagcagaggcccaacacccactccgacgtcagaaaaagaaggtggcatggtgtagttgtcagaacatggactttaaattcagacagagctggactcaaatatcaactccaccctcataagctgtcgaactttgggcaagacactgaacctctctgagccttgatctcacatttataagatgtagcttatcgtacgcatcaagaagggagaatgtaagaatttagaaataatacatgcaaagtgcccagcacagttccccgacacaaagcaagtgcttaatacatgggagctatacatatagttcctccactgactcagtaaagactgatagttgcccgcagagctttgggcacgatggaggtcaatatgagagggcatcagtggtttctctgaggagtgacatttgagctgaggaaaggatgagcagaaggtttttttggtgaaataagaagggaagagcttctcaggcagaggaaacagaatacgtggggcctgggataggaaagaagagatgaagattgaagagctgagaaaaatgtggctgaaactgagacaacaattaaagttttaaagcactcactcttggctgggcacggtggctcacacctgtaatcccagcactttgagaggtcgaggtgggagggtaagttgaagccaggagtttgagacaagcctgcgcaacatagtgagacccccccatctctactaaaaataataataaattagccaggggtggtggcatgcacctgtaggcctagctactcgggaggctgaggcatgaggatcactttagctcaggagattgaggctgcagtgagctatgattgtaccactacattctagactgggcaaaacagcaagaccttttctctaaaaaaaaaaagtctcactctaacaaggctacatactgaataattccaacaacatgacatctagcaaaggcaaaactagacgaagtttgtgaaaagatcagtggttgccaaggtttgggtggaaggagtgataaacaggtggaatgcgggatgtttaggggagagaaattattctatacgataccgcaatggtagatacatgtcacacatttgccaaagcccatagactaaataacactaagaatgagccccagtgtcaactagggactttggacgacgatggtgtgtagatgaggttcgattataaaaactatacccctctggtacaggatagtgagggagggaagctttgcacgtgtaggggcagaggcctatgcaaactgtactttctgtacaattttgccatgaactgaaaactgctctaagatgtaaactctattaatttttttttttttttgagatggagtctcgctctgtcgcccaggctggactgcagtggcacaatctcagctcactgcaagctccagctcccaggttcacaccattcattcccactcctccagagtagctgggactacaggcacccaccaccatacccagctaattttttgtatttttagtagagatggggtttcaccatgttagctaggatggtctcgatctcctgacctcgtgatccgcccacctcggcctcccaaagtgctgggattacaggcatgagccaccccgcacagccaagtctattatttttttttttttaaagaaaaaaacagaaaaactctctggctcctgtgtagagaagagattgggggcaggcagaggagaatgtgggccagttaggtttttctattttcttgctgggctcttaggggcaagttatagaagctctgagagcttcagtttcttcatctgtgatatggggacaagaatataaagtgacacagtgtgtggggaaatgcctcacagaaagcctggcacagggcaggcgttcaattcatgctgccggagtggggaagaatgacaatgcgaagagccgcaaaaggtgtcaggacacaagagctctttgtgcaggcacagtgggcatcctgtggtgccgttttgtggcaggtctcactgtttattggcaggaacaaataaaaatagcaaaagtctcactctttaacgggagaggcaaaacaagcgtatgttccaagcataaagttgtgttttgtgctttgatgaaaatcgacaataatcgtagctaagatttattgggtgctgactatatggcattgttgcaaggcatgtttgtaagcgtttaatgtgaattagctcatttcactctcccaaccataacttaggttagtttctattattatctccattttgtgtttggggaaactggggcacagcaagattcgttaacttgtccaatgtaagtgacagcgctggcttaagagagaatcaaaagatacaaacctgagctaacagaggaaatgggatgagcatgcttagaacagttttgaaatagacaaaaaagacgagtcatagtcatactcaatcatgtagaaagcagcatggtgtagaagttaagagcatggatttagaataagccagcctggatttaaattctggcttctccacttttggggtaacctcaggcaagttatttggctactctgtgactcagtttccccatctgtaatatggggatagtaacaggccctatcatgtggagtttttttttttttttttgagacggagtctcgctctgttgcccaggctggagtgcagtggcacaatctcggctcactgccagctctgcctcccaggttcgtgccattctcctgcctcagcctcccgagtagctgggactacaggcgcccgccaccatgcccggctaatttttttttttgtatttttagtagagacagggtttcaccgtgttagccatgagggtctcaatctcctgaccttgtgatccgcccgcctcggcctcccaaagtgctggaattacagacgtgaaccaccatgcctggcccatgtggagttgttttgaggattaagttggaaaatgcatggaagctcactagcttatcacattatatggcaaatagtaagaacttgatacatgtttgaaaacaaaggaaggctatagagatttctaaaagagtaaatttggagcttcaagcaaggagtggggctcaaactaaggctcaacagttctcatataaccaggtgctgcagctggtggctgcaaatatgaaagcaacttgacctctgccttcagggaccggacagtctggtggggaaggcaggctcaagtgcaagttatttttttaaaagcaggctataagaattattcattcaatgagaacacatggacacagggagaggaacatcacacgctgaggcctgctgcagggtggaggtctgggagaaggatagcattaggagaaatacctaatgtagatgatgggttgatgggtgcagcaaaccaccatggcacatgtatacctatgtaacagacctgcaccttctgtacatgtaccccagaacttaaagtataataataataaaaaaagaattattcattcaaccaaaatagtgccattcattctaagtactagggatggagtgaattatttacaaaacagataaaattcctgccctcaaggggcttatattctggtgccagaggttgggtaaggaacatataagcaagcatagcagtagcaatgagggctgttaaaaaataaagcaggatgacggtatagagatccacctgtgttattctgggtaggatggtcagagaaggaagtggtaatatttgagcaaggccgaaatgtagtgaaggggagagccatgttaatatctaggggaaaagctttccagttgagggaatagcaagtgcaaaggccctgaggagagaatatgcttgacctacacagaacagcaaaggatggaagtaccattgtgggtaaggggcaggagggtggagaggcagcagcagaagcctagatcatatgaggttttgcaaaccatagtcaggattgtgaatttcattctaacagggatgggaagcccttgtagagttttaaacatgcatttggcatctgatttagtttcagaagaatcactctggctgctgtgtagagaacagattgaagggggaaatggtggattagcatgtcttcaaattctctggccctccttccactgagaggtggggtgtccttaaacctaggtttcccctgtgcctgtctttgaccactagaatgagggagaagttgtgctgtgtaacttctgatgctagtccttaagatacctgcagcttctgcccctcttgtaatgtgccctcttgaaaaccagctaccacatgagaaatctgactatgctgagaccacatggctgtgaggaagctcaatagccacgtgaaggagcaccaaggcaacagactgaatgtgaagtttacttggaccttccagcccagccaagccacaagctgaatgcagtcaagtgagtcatcccaggcaacactgcatggagcagaagaaccacccagctaagccctgcccaaattcctggcccacagattgaaagcaaataaaatggttgtgggtttacaacacaaagatttggggtagtttgttccacaaaaaaactttatacaaatctccactttataaatgaggatacagatccagaaaggaaataattactgtcggtaagtggttgagctagactttgaacttataacttctctaggcaagttcaattttttttcttggtttatgactgttgctaaaatttccacatttattttaaaaccacatagaacaaaataaaatcatacaacatgttattctgtgttttagttgcctgcatgctgctatttttcccaggctagctgtgcaatggcttttaaagtggggtctgtagacccctggtgctagagtcacttaggcgaagcttgaaaacatgcaaactcctgggtctcacccaggaatctgactttctggtaccagggcacaagcatttgcattttaataagtagggtagaggtttcctaaattattcacatcacgaaaggtttgaatgtcaataaactagtggatcaacaagccctcaggaagcagatggacattttaaatgaagatagagagtttgcaaacagtaaatgcaaactgtaaatggagcactccatccctgttgtggggctctcctcactacactgtgttgcctgggtgaggagggggccctaagatggtctccccccaactcttctccccatgaggctcatctcagggagcagggaagggtgtacaagactagttgtggggtatgagatgaagcaggggtagagggaacattcagagagcattcactatatttcaggcactaacaattgaaagacttcctcatttagtcctcaaaaagaggcattatttccattttacagttaaggaacctgggagtcagaggtaagattacttgtacaaagccatacaaacagcaaacgggaagtcaagatttgaacccaggactgccagacaccaatgctagtgtttttttccaatattaagctgtgtcaaccaggtggaaggatcgtgtgatatgaaatcatatcagaactggagacctactcctccacctgtcagctatgtggcctcggaaaaacgtcatttcacttctttcaaagggaggatgaaatgtcctaccactgagaagtactgggtacccaacagccttttagtaaaaggtgattgcttctgaatgagaagacgccaggatgccaaggccaaaagtctgaagtggccaccgggcaatttctcccacagtggcatatgtcagggcaggacaggttcttggggggtggtggagtgggacccagagctggagtcattccgggtgtggctccagcacatgggaaagtgcacagggtcagcggggcgcagccagcggcctcacagtctttcccatccccagtttctgtgcttctgggaatcaggagccacactgtttttctctgtcggacccgagctctctctcccaggggagttggcagatctgccgctggcctgttggctggaggtgcacagcagcggagcctggcatcgctttacaggctcacactgcctctttcttgtgctgctctcttcccgttcccacgccccacctctgcaagtccccagggatcctgctttctccggcagtggcaagggcagaggccctgggtgaagagattagatgggggcttccccctccaaggctgctctgctgggcccctggacgaccctaagtgcctgaccttgcagaccacatccccgcctggggacacaaggctgtgggtggtgggctgtcaggaagtctgtgcctggtgcaagccaaggcctgactcccctcagccgtgagcttttcactttgcagagttgtaggattcttattcatgcaaagagtcggctggtcatgaatgccttcagcaaagatttaggcattgtgccaggtgctggggccacaattcggaaaaacagcttaacttgatcctcaaggaaggttcagtccagggggagacgggggaagtaaataataattaccctcctgaatcagttatagtacaggaagagcagtaagaccagaacacatagctgttggtgaagggctggtgcattccttcattcaatgaacaaatagttattgagaacctgatatgtgatatgggaatatagtgggaacaaagcaatctttctggctatctagaccttctgttctagaaaagaaacaacaaaataaattatacaatagcatatcttatatctctatattatttaatattatatgtctctgtattagcgatctagctagaatcgcttcaggcagtgataaatgtttgaaggaaaaaaaatgcatagttgggcctagagagtgcggacagcacggtctggcagggtctccctgaggaggcgacatgagatcagaaactcagtaggaggtgcatgggtaagagtggtcacatctgcagaaatgtttcaggaagaaggagaactagcaagcgccgagctagtaacacagacaccatggacatgctttacacataccacatctatgaagtgaggactctgtccccacttcaggtggggaggccaagagctagaaatagggagtgactgatcgaaggccttgcagcttggagaaggcagagccgggatccagcccaggcggtctgctttgcctacacaggtggcctctgtgccatgaagccaggccgcctacctgggctagtcctagatgctttgtgagctcggaggtgggcaccaaattcaacttcagggagggagagaagcgggcacagaagcacaatcttgatggatgagagcaaggtacatgccaagccaaggaagtctctgcctttctccttcccctcatttggcccccaagctgccacttacctgtgtgcatgtccacccaaagttgagagagagggaagctccaccctccatacacacggggctcgctctgctcactctgttttcctctccactcaagtcacctcctcaggaggccttccctgcttcccacacctcaaataccaacttctctgttgcttttgcttcacctgtttctcatgacctgcccttagcccacatatctgcttacttattgattgttttctgcaactctagtatcagctccacaggagctactgtctatttcattcaccactgtaccctctgtgtctggcacataatgaatgaaaggaaggaaaggaggaagcagcttaatgcatacagagacatttagaagaggtgaagggaacacttttccaaacacacacacaggtacctgggagtgagtgcaggaactgtgttctatgtaatgtttgctggagcctggcactcgaaatttgcctctaataaattctgttgaatgaatggatatctggaatttgaaattaaaagttcaggaagcccagaagaatctgggcaattatgtatgaaataaggagtaaagaaatgttattataaaaattaagtttcttgatgggatgttagagaagtcccaggatagagattcaggagtcaagggctcattgtggctcaggggctgatacgctgggaggatttggaaaagccacccttctctcttccctaagtcacagtttgcccatctgtaaaatggggacacatagaaaagtctaaggggctcttctgactctggaactctaagattttatagaccatcccctcctctgggacaagcccatgcatctccctcttgccccaaacatcctccctacaaacagtaagcctgggtgggagctggggagggggaggatctgagagactctgatgcctttcgtcaaggtcttgcattactgatgcttcctggctcctgctcttcagccctctctgaggtctgaccttctaatgagcggatgcacattatcagccgctgcggtttgaacgggtgcctataatttagtgttgcctaatgctggaaactgagagcagaacttgcgtaattagattggggtctcattaacgtctgcctcctcgggtgtttttcattcttggtttctcctgccctgtatttgcaatcccttctgtctgtataaacatggctgtccctttttatctctcccttgtggggccaggctagaatttgggtccagaacagcgaaggcactcacaaagcatgaattttaacatgccccgggatggcccctgctctgctttctaaatagagaacctggatgtctgggttgcgcttaagcacctcgagctggctggctggccaccctgggtttgggtttggacaaaaaccagaggaaggagggctatcaagacagctgctgcaaatactggtgatttaaccaacttgtgtacaatgcttggccatttacaaagcactcctagaatctgaccttgtaagcagggacctggtctattttgtccactggtcccctaagagttattctctttttgtgccctcctgaccccattctatgctttttccactcttctctgccctgctctgagctacaggagatgggtccctgttggcagcatcaactcagctcccttgctgaaaggtttctgcttgcctttggccaaagtgaggccccagcaggagactggaaggcagagggagagaagggggtggtacttctctctagtgcccactgtgctttagtgccatgactttgaaggtagctgagttcctccccagttatagcttcaatggaccagctctcctgctcaagtctagattaaacctactagatttagtctagaaattctattctctccttttgtcccttcacccctagggataatggtttccttctgttgtcagattctaaatacctcacgttcccttagcccctcacactcctccataagttgccccttccttaaagtctctttatttagaccatttaggggtgaattctgtcttttgcctggtccctgtctgatacaatacccaatgtctgaagtggtccctggaacatagtaggtccttaataaatgtttgtggaatgaatgcacaaacttttcatagatgacatctcatgtcatccttacaaaaactatgcaaaataatattattaccttttacagattaaaaaacactgaagctcagagaggtaaattctcatacctgagcaacagatttttaagggagggcaacactcccatactgtaccctgaatgagctgtagcttcactctgcaccctggagaaatctctacatactgctgctttctgtacagagactgagtgtccactcacgccagcctggtgtgggctcaacaggaccagaggctggtggagtggacaaagattcgaagacacttggaaattcactcggtatagaatcagagacctgggttcaaatccaagtggtgctactttctaaaagtgtgatctggggcaatgaaatcaatgacaatgatttaactgtcccagttgtgactcagtttcttcctctctaaatggggctataataattattattacacacttaatttagtgattatcctgatccaggcattgtgtttagcatttcacattatactaactcatgtaatcctcactgcaaccctatgaggaggtattgttattattattattaggaggaggagggggagtattacagataagttactgcccacggtcacacagctgctgtcaccgtggcaaatctgggatgtccaccaaggcagcctgcagcctgctccagaactgtgttcttaaccttcaggctatactggctgtctacattattattaggccatttcatgagttcgtaacaactaggtaagaagaccatctatgatgggcacttagcacagccctggtgcacaaggtgccatcaatagtggtgactgacttttccttgttccccacctaaaagtcagatgcatggatcctctccatatttttcttccatgtcgttgttcgattgtactcttgcatggcattcatagtaggagacatatggcttctttaagcagctctgccccttgccacacacaggccttggagccagactgccttgggcttgaatcctagctttgccacttattggctggagaactggatgtcattaccccatccattggtgtttcagcctttttatctataaaatggtgattttaatagcacacaccctatagggttgtcgaaaggatgaaatgagttaattcatgttaagtgcttggagcagtgcctagcacgtaggaaatgctataaaagtgtttgctaaataaataaaagttcatgaattttgtatgtgcaattcaagctggcttaaacaaaaagggattttttttggctcaactaagtccggatccagagccttgaataacatcatcagggcatcgtctctctgcttggctgtgtgttcctttaccttggcttcattcttggcagattgttcactcaaggagagagatggccaccagcagctccagacatacatcccatccgctctgtggtcccagcagaaaacatgtgcctttcatccaagagttctggcactggcctggcttgggtcccagtgagatattccaattgactggggctagtcatgtgccatcagctgcacacaccacacagactgcaagttggggagggggtcacctcaatggaatcctaggtgctgtttgccaaagcagaaggaatggaagctggagaaagccagcaatgatcttctctgccatccatcctggtcacctatattagtcagggttctccagagaaacagaactaacaggatatatcaaagaggagatttattatggggattggctcacatgattacagaggctgacaagttccacaagatgctggctgtgagctggagaaccaggaaagctcatagtgtgatttggtctgagtttgaaggcttgagaaccaggagtgtcaaccgtataatttcccagtctatggctggagtcttgagaattgggtggctgctggcatcagtcttgaagtctgaaggcctaagaaccaggagcgttgatgtccaagggcaggagaagacaggtgtcccaggtcaagagagagagatttagctcttcctctgtctttttgttctagtgggacccccagcggattggatgctgtctgaccacacggtgagggaagatcttccttgatgagcctactgattccaacgctcttccagaaataccctcacagacgcaacaagaaataaagttttaccagccctctgggtaaattaaccatcacatcaccattcctgaagttgctccttgtgagcaagacttcgggagatctagaccttggtcacaatgcatactggaagtgcttacaggcaatttcaatacaacgtctacatgtctttgaaagaatacacagcaagtcaagagcactgtttaacattcctattttgggagaccatagctaggacttgttatggccctatatgcctgtggaagattccactgtttttatttatttgtttattaaacttttattttaggttcagggttacatgtgcaggtttgttataccagtaaacttgtgtcataggggtttgctgtacagattattttgtcacccagatacaaagcctagtactcaatagttattttttctgatcctctccctcctcccacccttcaccctcaagtaggcctcagtatctgttgttctctttgtgtccatgagttctcatcatttagctcccacttataaatgagaacatgtggtatttggttttctgttcctgtgttagtttgctaaggtaatggcctccagctccatccatgctcccacaaaagacatgatctccttcttttttatggctggatagtattccatgtatatgtaccacattttctttatccagtctaccactgatgggaatttaggttgatttcacgtctttgctattgtgactagtgctgcaatgaacatttgcatgcatgtgtctttatggtagaatgatttatatttctttgggtatatactcggtaatgggattgctggatcaaatggtactttggaagattctactgattccccccactgaaggacacactgagtcacaggctacttagtgtgtgtgcacattctcatgggtctgacatcctgtaacaaatcttgctaaagtgagctacctggctgagattgtaagcaccatcctgggcatgagacagaataaatctcaacagccatatgggtccctgaacccaggcctttagctatactggcactgtcttcacagccctggctactcaaaatgtgatcttccaacagcagcatcagcagcatccaggagcttgttcacatccttgctgctcaaactgaacctgcaagaccagatgcactggcttcatctgggagctcaaagaaaactcaaaatctcaggccatacctgaagacataatggatgaagatctgcattttaacatgagatctcccagaggtgtgtaaacacattaaatttcaagaggcactgctatattcattttctagggctgctgtagcaagggaccacaaacttaatgactttaaacaagagaaatttattctctcatggttctagaggctagaagtccaaaatcaaggtgttggcaggctgggcttggtggcttatgcctgtaatcccagcacgttaggaggccaaggtgggaggatcgcttgagctcaggagttcgataccagcttgggcaacagagcaagaccccatctccaccaaaaatttaaaacttaggcaggcatggtggcatgtgcctgtagtcccagctattcaggaggctgaggtgggtggaccgcttgagcccaggaggttgaggctgcagtgagcagtgatcgcatcactgtaccccagcctgggtgacagagagagaccctgtctcaaggaaaaaaaaaagctattggcagagttggttttctttctgagggtttggcaggagatgcctgtctcctagcttctgatgattgtcagcaattcttggtttgtcaatgtatctccccagtctctgcttccaacatcacagggtgttttcccgtgtctaaatttccctcttcttataaggacaccagtcatattggattaagggctcacactactccagtataactgcaccttaatcatcacatctgcaacaatgctatttctaagtaaggtcacgttctgaggtactacgagttgagacttcatctttttccaggggagcataattcatctcataacaactgccttcaaagtctgccattcctgaatgctggaagaactgccaattagcaaatacctggaacatttctgtaactttatttttgtaaacaatgttgtaaattcaggaagaatatggcaggtctagaataagacttgaagatgtctatttttgcaaagtgattcttgtgttcaggcagcatacctaggagtgtcctcagcttttcagcccgtcctgcctcagtgcagggccatgttgagaacaatctggggatgtttcctactttggctgccactagaatcacgaggggagctttaaaaatatgaatacctaaatcccaccctcagagattccagtgcaatacgtctgggacactgcttgggtatcaggattttaaaataattcctaggtgattctaatctgtagctaaatctgaggaccaatgggatagttgttcttttttttttttttttgtggcagggtctcaatctgtcatccaggctcactgcagtggctcactgcagcatccgctcccaggttcaagtgattctcatgcctcagccactcaaatagctgagactacaggcgcacaccaccacacctggataatttttgcatttttattagagacagggttttgccatattgcccaggcttgtctcaaactcctgatctcaagcaatctgcccaccttggcctcccaaagtgctgggattacaggcgtaagccattgtgcccagccgggatagatgttcttgtttttacctgttacaaatgaaggagatccagccaccctaccaaatagggaagcagacacgagtacaaaaaataccaaatatgagcacagattcctaaacaatagcattttaggctttttatagtacttgtgtgcaaaatgagggtgctatgaagaagtacatgaaagtatatatttagcattattctcctaatctccaataatcaggaacttctttatgtctccttatagttttgtccatttttgaagtatatcttgaggtatttttatatagtgcttatacatttaaaattatttcttctaagtaaatgaatctttatcataataaattacttccttttccctagtaatgcttttcaccttcgagtctattttttcccccagacattaatgcagctgcatcagtgagctttcttttgctgcacagttgcatggtatatttttcccctttctttaactttcaaattttctatatgcttatattttagatgaatgtcttgaatggaaaacatttagattttttaaaagttacactgataactcttctctttaattagtgcatttagtccatttacatttaatgtaattattggtatacatacactggtgacacaaatatttaacaactcccagagtactttgtggggtttgcagttctcacaaatgaccatgagagggcgaatccagaagatgcacaggcatttatagccttgaagagacaggagaaaccaagcattcactctctggggttccactactacttctgaggttcttccctacaatgtctgggcatcctgtggccaggggagaacaagaatatgggcttggggacaggagtgtggtggactgggggacacaggaacagtctcatggggttaaggtggctgaagtcactcagtaggctcaaggcaatggctatttacctaccggtatagaaaagtttcaatattttaataaccagcactgctgtataagcaattcagaatgatatcagatcagacctgctgttatattgggtgtaaatcaaccatttactttgtgttatttacaacacctgttctgtgttggtttttaaagcctgctattaatatatttacttttttttttttttttttgagacaagatgtttctctgtcacccaggctaaagtgcagtggcgtgatcacagctcactgcaggtttgacctccccgggctcaatcaattctaccaattcagcctccctgagtagctgggaggatttctgctatttttttgtatttttcatagagatggagtttcaccatgttgcccaggctggtctcaaactcctgagtgcaggcaatccacccacctggcctcccaaagtgctgggatttacaggcgtgagccaccacacctggccatgtttactttcttccctgacaatacaagggcctcagaatatcttaattccatttaccctcaatctctactaacttaatgttgtatattttaatccttcatatatttttaaatccataaaattattttattgtcttttgaagacaatacctattaacaccactttctttgcccttcatataatcttgcagctctacgttaatctgaggtcattttatttttgcctaaagtacatacatactttacagtttccctttgtgaaggtctgtaaatgtttttattttgccatcattcataaaagatgtttctctgaggatagaattataggttggcaattaatttctctcagcacactgaagacatttttccaccactgttctcaggaagctgccagtctgttactttaacaaaagtacagatgttccttaacttacaaaggggctgcatcccaataaacccattgtaaactgaaaatatcctaagttgaaaatgcatttattggccgggcgcagtggctcacacctgtaacctcagtactttgggaggccaaagtgggaggatcatgaggtcaggagatggagaacatcctggctaacacggtgaaaccccgtctgtactaaaaatacaaaaaattagctgggcatggtggtgggcgcctgtagtcccagctacttgggaggctggggcaggtgaagggtgtgaacctggaaggcagagcttgcagtgaaccgagatcgcaccactgcactccagcctgggcgacagagcgagactccgtctcaaaaaaaaaagaaaaaaagaaaatgcatttattacccctaacctaccaaacatcatcgcttagcctagcctaccttagacattatcagagcacttacattagcctacagttgggcaaaatctttgaacaaaaagtctattttataataaagtgttgaagatctcatgcaatttattaatgctctgctgaatgagtgtcactttgcatcatcacaaagtcaaaaaatcataagtcaaaccattgtaaattggggaccatctgtaatctgccttttttcctctggctttttctttctaaatatcactattgagtcttggtgtggaattatttttatttatccgcttgaaatttgccaagcttctgctttcggtggtttggtatctttccaaaacaatcatttcttcaaatactgtctctgctctattctcttttacctctctcttttgagattctgattaaatgaatattaggccctctcctagaatctaacagtctttcctgcacctccgatctttttctctctgtgcttccttcaggataatctcttcagctgtacctttcatttcataaacgctttttcagccatgtctaatgtgatgttaaacacaataattttgattactgtagttttcatttccagaagttgtgtttaaaaaaaaaatggttgtatcggctggtcgcggtggctcacacctgtaattccaacactttgggaggccaaggccgggggatctcctcaggtcaggagtttgagaccagcctgaccgacatggcaaaaccctgtttctactaaaaatacaaaattagcctggtgtggtggtgcatgtctgtaatcccagctacccgggaggctgaggcagaagaattgcttgaacctgggaggcggaggttgcagtgagccaagatcatgccattgcactccagcctgggcaacaagagcgaaactccatctcaaaacaaacaaacacaaaaacctggttatataactttttttagtgtccttttctccgcagatatctccatacctgatttttttcaatttgatatgtatagtttttaaaaataacctgtgtgataattctaatgtcttctgtctttgaggttctgtctccattgtctattgttcctgtttcacctggttatctttgactacgtactagctattatacaaaaaaattatttgaaggatcatttgaagcctagcttgaaagtgccttcctttacataggatttgcttttatttctggcatgtctgggatcaccataaaccaagttcaatgcctgaggtttcctggagggctggggtattcaaactgcaattcaagctgcaagtacttgtgagggctcacctacttgtaattcatgttcacctagaagctgtagtcctttggggaatctcagcttattgtggagagggtctactgttacactccctattgtgagtggccctgagtgttgatttctgtctcccttgcctccactaagctctcaaaaccagttgcaaatttggctgatctagtgaatactctcaggatacaggtggctttgtactcatttacctgtctgggttttcattttcccatcagtctcttcctggtaattccttactgtcacaccaactcttagaaggcctttaaagactgtaattatttagtatcagtttttacgttgttttcaggggaaaagctggtccaaatgacctagcccaccgttactggaaataggaagccaaatgtctttcatggcatacagtaggcactcaataaagaatggctgaattagttgaattatcataatttaccaaatgatatggtttggctgtgtccccacccaaatcttatcttgaattgtagctcccacaattcccatgtgtcatgggagggacctggtgggaggtaattgaatcatgggggcgggtctttctcatgctgttctcgtgttagtgagtaagtctcaagagatctaacggttttataaaggggagtttccctgcacaggctctcgttctctcttgtctgccatcaggtaagatatgcctttcaccttccaccgtgattgtgaggcctcctcagccacgtggaactgtgagtccagtaagcctctttttctttatgaattacccggtctcgagtatatgtctttatcagcagcatgaaaaaggactaatataccaaacatgcacctttttttttggatctgtctttatttgcagaggctgtttcctactcttaggatatacttctctttccctacacccagcctgagaatgtccacattctaccattggaccaggctcagaacaaatgttaccttttcctcaaagcttttcctgttttccctccttccccaaatctgaatcctgtctcttccttctctaaaccctcatgagacctagtgtgtatcgttctctgggtacttaactagatagcaatgtattcatacatgtgtttatctcgcctatggatttatacattcttgtcatttttggcttctgaagaaacccctcacttgctctccaattcagcataaattacaaacagatttctgaacatattatatatctagtgcttttagttttggtctacttggagaagattctatgaacacttagtctgccatattgcaggaagttgaatttcatttattctaataaaccttccattcgtaccgcacttcagagttaacagggtgctgtcatacatgtgagtttctgtaaactttagcagcctctaacttcagtgcatatcatcatgctgcagatgagaagtagaggacaaaagggactaaataatatgccagagcagagcctcaaagccagaaatggaacccaagtcttttctctccaagcccagggctcacttggggacaccacaggtgctgcacgtatgatatgtgccgctggtcattactactgcaaccacacctgggaagcagacattctgtacaggaaagtacatgtggcaaaggagttaggtcgcaggaagtggacggaggggtgggctacatgaggttccacgtatgcaattctcagaaggttctgcatattttaatcctacttacctcaccactttggtcccatttctcacgacctgcatgtccaccatgcagcccccggtcacataggcagctaggttcaactctgagaattcagcctgaagaataaagcaaagcaaaaaaggattcatcaaataccaacggtggtaacaacggttaacacatattgggtacttagaggtacaaagtacacctttaaagctcccctcaaacttaggaagttgccgatattattttcatctttctttttgaaagatgaggaagctgaggctctaagaggcctggtggcatgtccaaggcagcacaattaatacaaggccaaactggattgaagcccatgtgtctctgattcaaggacctatgcttttaatccttgctaatttctgcctctttgaaggtggaagaggcaattccagctccaagaccagaacatgccagatgctgtttgatgggacattttctctagattttctcaccttcatgctctacagtagtatggcatcatgactctgcagatgctgtttgatgggacattttctctagattttctcaccttcatgctctacagtagtatggcatcatgactctgcagatgctgtttgatgggacattttctctagattttctcaccttcatgctctacagtagtatggcatcatgactctgcagatgctgtttgatgggacattttctctagattttctcaccttcatgctctacagtagtatggcatcatgactctgcagatgctgtttgatgggacattttctctagattttctcaccttcatgctctacagtggtatggcatcatgactcggtgattatttctctctattaacggacccaccccccaccctggtcatatgcccagttttcttctcttggtaatggcccctcctcttgctccatccatctggttacagcagcagcaccatgtttgttcattgacatactgcccttttggtcacagttgatggggtaagcatctgactcggggtggaagaatgagatactcttccctgagagtttgaaactgatgagtgagtcatgcagtttctttctaggtggttgtatctttaatgcacaaaccatgttttctgtcatctgcactggcaaagcacagaaaaccagggtggagagagacagagagagggaggaatgtcacagtcaccaagagaggggcaggggcaagagatggggatgtttatgtgccagctacagacctacctttggattttgtgagttcatcttttgggttgcctatttgtttaaatgagctttcatggatttctgttgcttacaaccagagtcccatggaatacatccctcttaccagatgacatgctccctgggatttctcactataaccacctgtcttagtctcccaaggctgctgtaataggtggcttaaacagcataaattcattctccacagttttggaggctagaagtccaaaatcaaggtgctggtagggctggttcctgctgagggctataagggaaggatgtgttccagacctctctctttggcttgtagatggccatctgctccctgtgtcttcttacattgtcctccttctatatccaaagctcctgttcttataaggacaccagtcatatacactaccctcactttaatagcctcactttaacttgattacctctttaaagaccctatctccaaataaagtcacattctactgtgggttaggacttcaacatatgaattttgggggtgacaagtcaacctataatgctatcggctaaaatgcatagcaccaaactgtgccttatacacagtagatgccaaaagcaatttctttgggtttaatggataaacataaccactcacatgtatgaagcactcactatgtgccaggtaccggcctaagcattttacacatatgaattcatttaatcctcatgcttgtccagatgaggaaatggaggcagaaaaagatcaaataacatgcacagcatcatatagtaggtagcagagctggtattcaaacccaggcggtgtggcaccagggcctgtgtttttgttgttgttgttgttttcagacagagtttcactctttcacccaggctggagtgcagtggctcaatctcggctcactgcaacctctgccttccagtttcaagcaattctcctgcctcagcctcccgagtagctgggattacaggtatctgccaccacacccagctaatttttgtttgtttgtttgttttttagtagaaagggggtttcaccatgttggccaggctggtcttgaactcctgacctcgtgatccgcccgcctcggactcccaaagtgctgggattagaggtgtgagccaccacgctcagctggccctgtgcttttaactgccacactccatggcccccactgttcagctgaatgaggcattaggtggcttataactgggaattttagggacctaaaaacaacccatttaaagaaaaaagtttacattgaagggaaatatcatttcatggcaacttaactgtatctccttggagtcatttaacaggaattatgaccaaagacccagccatctccccagatagcattagagcaaaccgggagtacttacgcctcttgctgtaattaataacctcattatgctgtggcaaggcgaaaagatcactgtgaatgagtccaggttagtaaatagtggtaatggcctagttattaagtttaatgccttaaacattcagtcccatcatgttcaagattcttagttggcaaggtcacaaagaagaattaagaagaaaagttgttgcttatgtgcgcagataaaaagacattagaagaaagttgcaaaacaggatacctggtcaccaaatatatgcagagagggagtgaaacagaatcttggaagatagaatctctgactcaaaagtggcaaggacccaagggctgtctcgctgcccaaatggaaagagagatacctggagagaagtcacactcaggcttggatgtacaagttagaggttcatcttgttcagatgtgggtgtctagagttatttctcagttgtggtttatgaataattacaggagataactgcctgggttgcaaggtagccagcttccgtgggatcaagcagaaaggtggcctagcaaagtaaaagggcattcttctgttatttaactgtctaaaaccttcagcaccatggaaatgaacacagaggtgtccaaaccaccttcccttcaagatagcttgatagcctttctggtagaatatgaaagagcagccatttggaagactctcatgaaaattgtagtgaattgaattgtattcctcaaaaagctatgtccaagtcctaacctctgatacctgtgaatgtgacctctttgggaactagggtcttttcagatgtaatccagttaaggatatcagatgaaatcatcttagactggtgggagttgcgggggaggcacactaaatccactaacaagtccttagaagagaagagacgaggaaaagacagaaagacacaggaaagaagatcatgggaagatggcagcagagatggagtgatgctgccacaagccaagaaatgctgagagtcactagaagctggaggagccaaggaaggtctcccctggagccttcagagggtgtgcagctctgctgaaaccttgatttgggaattttggcctccagaactggaagaaaataaatttctgttgttttaagccactaagtgtatggtaattgtggaacctagcaaattaaaataataactttgggaattgaatgcaatttcagtatcatattcaaagtcaccagggctcgaagaaggtcaatgtggccaggtaaagctcctttattcacttcaccaaaaacatgcgcatagaaatctgcacctagactcattctctctctctctttctctctctctctctctctctctcacacacacacacacaaaataacaaattagttattcacctatatcgcaaaaaacgctactatcagaattacttaaatattctgcatgagctaaccttttcaccacaaattattttgacctctaaggcttttggtatggtatttttttttttttttttttgagatggagtttcactcttgttgcgcaggctggagtgcaacggcgtgatctcagctcactgccacctccacctcccaggttcaagcaattctcctgcctcagcctcctaagcagctgagatcacaggcacccgccaccgcgcccggctaatttttgtatttttagtagagacagggtttcaccatgttggccaggctggtctcaaactcctgacctcagggcgatccacccgcctcagcttcccaaagtgctgggattacaggcgtgagccactgtgcccagctggtgggataacattttaatactacacattaggcactgtggtatggacaaatgagtactcagagagactacattcacatgtaagctgttcaatatactagctgatgagtttagtgaagttactgatttgaatatcaattttgatatctttaaaacagaggtaatgatatcaataatatctatctttaaatgtttttgtgatgattcaagacaatgtatatgaaacatccagcacagggctgagactcagtaaatagttgccattattattttcaaatattccattgtcttagtaagcttaaactgaaagcatccaaactggtgtaccctgaaaaagaacaactccttcaagtatttataacatatacatttaaaaaatatatggaggtgtgaaatgtaaagacttctgcatatggcaacaatgaagtaccagagattacatatacactcccatcttaaacaacaataaagccagacaaactgcattacatatcagttttcaggaactagacaacaggcatttcaggactatgattcctgtaagagggaacaaaattatccctatgtttatcctagcttactgcctagaggcagtttccaggcagcagaacagcatgggagaaggcagagttcatcagtttcactgagttaaggatacaaagattgaagttcagggtagccatggcagctaaaatttgcaggacagagtataggaaaagatgaatctgcagagaaaaaataaaacaaacaaacaaacaaacaaacaaaaaacctcacaaactccagggagatctatgtctttcgctgagtaactaatttgagcatacatgaaaggaaagtaatcaaggccaggaaaaagccattaggaaacaatctccagaatccacagagctgggaagaacccatgtgctcaccagctagagggtaaagaccttgtcaaatgggtaggttactcaaaatttcatagtgggactgaattatccctggccaacagcatgctctggatctaggacgaccagtttgtcccggtttgccttgggctttctcagctttaaaactaaaagtcccatttctcagaaactcttcaatcccagttttacagtgaaagtcccatgtcttggaaaactccttaatcccaggcaaactagaataatcaatcactccatgtagatctgtcccaagaaaagcttaaaaccaagtcttgaatggatcaagtttattacaagtaacttaactgcatctcagaaaaaactaaaccactgtttaaaggaatctaacaaaacccagcacccaacacatcacattcacaatgtaaaagtagtgacattcaatcacaaattacgaggaatgcaaagaagcagaagaatatgacccacaacaaggagaaatcaacgaatagaaacagacgtggaaatggagagatgatgggaagagcagaaatggaagttaaaacaactgttataaagaggttctcaagaatgtagatggaaacaatacaatgggagagaaagaaacatattttaaaaattaaaaatgaaacttgtagagataaaaattataatatctgaaatagaaaatgcaccgctaggcttaacaacagattagacacttgtatcagtctgttctacactgctatcaactacctgagcctaggtagtctataaagaaaagagatttaatcagctcacagttgtgtgggctgaacagacttctgcttctggggaggtgtcaagaaacttacaatcatggtggaaggccaagggggaagcaagcactatcctcatatggcagagaagcaggagagagagagagcaaagggggaagtgctacacacttttaatcaaccagattttgtgagaactctataatgaggacagcaaggcggatggtgctaaatcattagaaaccacccccatgatccaggcaccttttgccaggccccacctccaacagcggggattacaattcaacatgagatttaggtggggcacagagccaaaccatatcatgctgctgaaaaaaatgctagtgaacttgaagagaaaacaataaaaacaacccaaaatgaagcacagagacaaaaatacacacaaaaaaaagcaaagaaagaaaaagagagcagaacctcagtgagttatgggataatattaaatagtctaatatatgagtaattaaagtctcagtaagagaagaggtagggacagaaaatttaaaacaaaatggccaaagtttttctacatttaatgaaaactggacctaacaagttcaatgaatcataagcagaagaaacaaagaaaataaacagcaggacatagaataaccaacttattaaaaaccagtggtgaagagaaaatcttcaaagcagccaaaggggggaaaatacattttatataaagagaaacaaagataagaatgataaacagcttcttgtgagaaaatagaaaaccagaagatagtagtaaatcttccttaaagagctaaaagaaaaagaaaaccaggctgggcgcggtggctcacgcctgtaatcccagcactttgggaggccgaggcgggtggatcacaaggtcaggagatcaagaccatcctggcaaacacggtgaaaccctgtctctactaaaaaatacaaaaaaattagccaggcgtggtggcgggtgtctgtagttccagctactcgggaggctgagacaggagaatcgcatgaacccgggaggcagagcttgcagtgagcagcaatcgcgccactgcactccagcctgggcaacagagtgagactctgtctcagaaaaaaaaaaaaaagaaaaagaaaaaggaaaagaaaaagaaaaccaaccaaaaaacaactgtcggtatggaatattatacccagtaaaattatcttttaaaagtgaaggcataggccaggcacagtggctcatgtttgtaatcccagcactttgggaggccaagacgggtggataacctgaggtcaggagttcaagacgagcctggccaacgtggcaaaacctcgtctctactaaaaagacaaaaaatcaacaaggtgtggtggcacgcacctgtaatcccagccacttgggatgctgaggcacaagaatcacttgaacatgggatgcggaggttgcaatgagcagagactgcaccactgcacttcggcctggacagcagggcaaggctttgtctcaaaaaaaaaaaaaaaaaagtgaaggcacaataaagacttttccagacaaagaaaaattgaatttattataagtccaaaatgtgttaaaggaagctcttcagacagaaggacaatgataccagatggaaatttgtaccaatacaaaatgaagagttctagatatggtaaatatgtggataaatacaaaacccttatttttcagtttaaaaatatcctataaaagattattaactgtttaaagcaaaacattgcaggcatcatgggagtttataacctgtagaagtaaaatgaacaacaacaaggacacaaagaaagggaatgagaaatggaaatatactgctgaaaggttctcacagtatatgtgaagtggaataacactatttgaaggtaaatgatgatgaggtaaggatgtacattttaaaccatagaacagtgccttgaaaaggaaatatagataaaataaataaagtatacaaattttaagtttatagcttgatgaattttcatttatttatgctgtgtaatcaatcctcagatcaagatatagatcatttctagaacccctgaatcctccctcatcctcattccagctgatctcacccccacaccatgatgctaccattttaatgtcttctatctcatagattagttttacatgttcgtgaacttgctataaatgaaatctcacagtacatgcactttggtatttgccttctttcatatctgtgattcatccatgctgctgtggttagcagcagtcattcttttttaatttctgtgtagtatttcattgtctgaatattcaataatgtgtttatccattctgctgatggtagacactttaactatttctattcatcagctactaagaaaagagctgctatgcaccttcttatacatctcttttggtggacatatacattcattttcctgggttatatacctagaagtggaattgctgggtcagaggataggcatacaggatttagaagatacagatggagaattttcctcagtggttttgccaatttacataccgttagcaatatgagaattacagttgctctgtgtctttttcaacacttagtattgtcaaagtttttaattttagccattcttcaggtgggttgtgtagtaatagtacattgtagttttagtttacatttctctgatgattaatgatactgaccactttttcatgtgctaattaacaatttaggtaatttcatttggtgaagtgcctgttcaagttttttgttcacatttgtattcttgtttgcatttatcttattaatttataaaggtatctcaaaatatattgtagatatgagttctttgctggatatattcatttggaaatttcttcttccattctgtggcttgtctcttaactttcttagttttttaacgaagaatatatttatgcacacacatatgtatatatgaagtacaatttagtattttttttacagttagtgtatctattgtctttagcttaaaaaatgtttgcctatcccaaggtcatgtaggcactctcagtgtttcctgctagaagcttctctgttgagtatttcacatttacgtctgtaatccacctagaatttttaaatatatactatgtgaggtaggaccgaaggttcaatttttttcatatggttattcatatactttggtaccatttattgaaatgagcactctttctcaatagaattgcattggtacctttgccaaccaccaagtcacttcataggtggcagtctatttctaaattctctattttattctatttatcaatttgtctatcctgtttcaagttgtcacaattaatgtagctttacagtgagtcatgacatcagatagtataatattctaagacagaagtgacccaaacaagccccagtgatgacaggagcaaaggcaagataggatgaccatcctctgtctccttaacctactgatcagaaaaaaagttgtcttatttgctcactgcaaaatacacatggacactggtcaatcatatgacctcaaaggctctgtcctgaataaactgattagatgtttccctagcaatatgattgactagacagaatgtgttctactattccttgctttgcaaccaacccaccattgcagccagacctctcaaagacctcctcaacgaaaccctcacttatcttaaaggttaaaaaaaaagttttattaattaaaaacaaaaaaatccacaattcttaacagcttgttagtatggtcagctggttgagagggtaataaatggaggagaaagcacatctattcttttagatcatcacctatactgaggaccggcacttatggcaactcactattgacatgctcacacacctctaaaggtttctctttgctttataacgaactttcacacttcagcatatttctaaacattctttaacattttaacttcttttccaccttgttgaaagcttgagcccactctctcatttgtattattttttgcgcatttgttgctagccagtgcatttttaaaaatttctttcccgggccggttccaagatggctgaataggaacagctccagtctacagctcccagcatgaacaacgcagaagatgggtgatttctgcatttccaactgaggtaccaggttcatctcactggggtgtgtcggacagtgggggcaggacagtcggtgcagcccaccgagcgagagccaaagcagggcgaggcatcgcctcacccgggaagcgcaaggggtaagggaattccctttcctagccaagggaagccatgacagacaccacctggaaaattgggtaactcccaccctaatactgtgcttttccgagggtcttagcaaacagtacaccaggagattatatcctgcgcctggctcagaggatcccacgcccacggagcctcgctcattgccagctcggcagtctgagatctaactgcaaggcagcagtgaggctgggggaggggcatccgccattgctaaggcttgagtaggtaaacaaagcagccaggaagctcaaactgggaagcccaccgcagctcaaggaggcctgcctacctctgtagactccacctctgggggcagggcatagccgaacaaaaggcagcagaaacctctgcagtcttaaatgtccctgtctgacagctttgaagagagtagtggttctcccagcatggagtttgagatctgagaacagacagactgcctcctcaagtgggtccctgacccccgagtagcctaactgggaggcacccccaagtaggggcagactgacacctcacacggccaggtacccctctgagacaaagcttccagaggaacaatcaggcagcaacctttgctgttcagcaatattcgctgttctgcagcctctgctgctgatacccaggcaaacaaggtctggagtggacctccagcaaactccaacagacctgcagctgagggttctgactgttagaaggaaaactaacaaacagaaaggacatccacaacacaaccccatttgtacgtcaccatcatcaaagaccaaaggtagataaaaccacaaagatggggaaaaaacagagcagaaaagctgaaaattctagaaatcagagcgcctcttctcctccaaaggaacgcagcttctcaccagcaatggaacaaagctggatggagaatgactttgacgagttgagtgaagaaggcttcagacgatcaaacttctctgagctaaaggaggaagttcaaacccatcgcaaagaagctaaaaccttgaaaaaagattagacaaatggctaactagaataaccagtgtagagaagtccttaaatgacctgatggagctgaaaaccatggcacgagaactacgtgacgaatgcactagcttcagtaaccaatttgatcaactggaagaaagggtatcattgattaaagatcaaatgaatgaaatgaagtgagaagagaagtttagagaaaaaaagagtaaaaagaaacgaacaaagcctccaagaaatatgggactatgtgaaaaaaccaaatctacgtctgactggtgtacctgaaagtgactgagagaatggaaccaaggtggaaaacactctgcaggatattatccaggagaacttcccaaacctagcaaggcaggccaacattcaaattcaggaaatacagagaacaccacaaagatactcctcgagaagagcaactccaagacacataattgtcagattcaccaaagttgaaatgaaggaaaaaatgtcaagggcagccagagagaaaggtcgggttacccacaaagggaagcccatcagactaacagtggatctcttggcagaaactctacaagccagaagagagtgagggccaatattcaacattcttaaagaaaagaattttcaacccagattttcatatccagccaaactaagcttcataagtgaaggagaaataaaatactttacagacaagcaaatgctgagagattttgtcaccatcaggcctgccctacaagagctcctgaaggaagcactaaacatggaaaggaacaaccggtacatctggcatgaaaaaacatgccaaaatgtaaagaccatcgatgctaggaagaaactggatcaactaacgagcaaaataaccagctaacatcataatgacaggatcaaattcacacataacaatattaaccttaaatgtaaatggactaaatgctccaattaaaagacacagactggcaaattggataaagagtcaagacccatcagtgtgctgtattcagtagacccatctcacgtgcagagacacacatagactcaaaataaagggatggaggacgacctaccaagcaaatggaaaacaaaaaaaggcaggggttgcaatcctagtctctgataaaacagactttaaaccggcaaagatcaaaagagacaaagaagaccattacataatggtaaagggatcaattcaacaagaagagctaactatcctaaatatatatgcgcccaacacaggagcacccagattcatacagcaagtccttagagacttaacaaagagacttagactcccacacaataataatggaagactttaacaccccactgtcaacatcagacagatcaacgagacaaagttaacaaggatatccaggaattgaactcagctctgcaccaagtggacgtaatagacatctacagaacactccaccccaaatcaacagaatatacagtcttctcagcatcacatcacacttattccaaaattgaccacatagttggaagtaaagcactcctcagcaaatgtaaaagaacagaaattataacaaactgtctctcagaccacagtgcaatcaaactagaactcaggattaagaaactcactcaaaaccgctcaactacatggaaactgaacaacctgctcctgaatgacatgatcaagtgggcttcatccctggttgcaaggctggttcaacatatgcaaatcaataaacgtaatccagcatataaacagaaccaaagacaaaaaccacatgattatctcaatagatgcagaaaaggcctttgacaaaattcaacagcccttcatgctaaaaactctcaataaattaggtattgatgggatgtatctcaaaataataagagctatttatgacaaacccacagccaatatcatactgaatggacaaaaactggaagcattccccttgaaaactggcataagccagggatgccctctctcaccactcctattcaacacagtgttggaagttctggccagggcaatcaggcaggagaaagaaataaagggcattcaattaggaaaagaggaagtcaaattgtccctgtttgcagatgacatgattgtatatttagaaaaccccatcgtctcagcccaaaatctccttaagctgataagcaattcagcagtctcaggatacaaaatcaatatgcaaaaatcacaagcattcttatacaccaataacagacaaacagagggccaaatcatgagtaaactcccattcacaattgcttcaaagagaataaaatacctaggaatccaacttacaagggatgtgaaggatctcttcaaggagaactacaaaccactgctcaacgaaataaaggaggacacaaacaaatggaagaacattccatgctcatggataggaagaatcaatattgtgaaaatggccatactgcccaaggcaatttatggattcaatgccatccccattaagctaccaatgactttcttcacagaactggaaataactactttaaagttcatatggaaccaaaaaagagcccacactgccaagacaatcctaagcgaaagaacaaaactggaggcatcacgctacctgactttaaactatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaaggattccctatttaataaatggtgctgggaaaactggctagccatatgtagaaagctgaaactggatcccttccttacacctcatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaacattgacaaatgggatctaattaaactaaagagcttctgcacagcaaaagaaactaccactagagtgaataggcaacctacagaatgggagaaaatttttgcaatctacttatctgacaaagggctaatatccagaatctacaaagtactcaaacaaatttacaagaaaaaaccaaacaaggcgatcaaaaagtgggcgaaggatatgaacaaacacttctcaaaagaagacatttatgcagccaacagacacatgaaaaaatgctcaccatcactggacgtcagagaaatgcaaatcaaaaccacaatgagataccatctcataccagttagaatggcgatcattaaaaagtcaggaaacaacaggtgctggagaggatgtggagaaataggaacacttttacattgttggtgggactgtaaactagttcaaccattgtggaagacagtgtggcgattcctcaaggatctagaattagaaataccgtttgacccagccatcccattactgggtatatacccaaaggactataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaaggatgagttcgtgtcctttgtagggacatcgatgaagctggaaaccatcattctcagcaaactatcacaaggacagaaaaccaaacaccgcatgttctcactcataggtgggaattgaacaatgagaacacttggacacaggaaggggaacatcacacataggggcctgttgtggggccgggggagggggagggatagcattaagagatatacctaatgtaaatgatgaattaatgggtgcagcacaccaacatggcacatgtatacataggtaacaaacctgcacgttttgcacatgtaccctagaacttaaagtataataaaaaaaacttttttcccttatttttaacagaaaaaaagaccccatgccataatatattgctttagtaaatgaagatggctgcatgtaattctgattgttttaggggggaaaatagccatgttatacatttgtaggagattatgtctagacatcattaaggacaaataggttttaattctttggtctctagatgagggctatatataggcacagacagagctcttggtattttgctactcttgctaaactagctgtgagaggttttcaacactgatctcaatgataactgaacgtactggactatctgagcttttctgtttgtgtataactctttaaatatgtacttggaggaacgaataaatggtggaaaagggattggccttgaagtctggagatcagagatctaaatcttgaatttgacactgacccagtgtatggccttaagcaaacccctcacttcctctctgctcttaactctcttcatctttcaattaaagagctataattaattgaatcaattatgtccatggtctatttaactgttatatgttcatctttttctcaaccaatgtcccctaactgtcatcaaagaaatcatctattatcatggcatactttataagaaagaaatgccagccaagtaggaatattttttataagaaagctgttcattgttttatacccagctcctggcacacagtaggtattcaaaaatacttatcaccaaaattttttatattttacagatgaatggataccctcacacattaagcaacttgccttctgaaactgcattgccagggcctccagactgtgacaaggaggatgttttcaggcagagagcaggggaaaggctcaacctaagtttccaggaacaaaagcacaggtgagaatagggctatggggccaatggaatggtgaggtgtcgtttgtagctgggacatggagtatatggaagcacataatagaaggcaaaggttgctgggagaccagttcatgaagattttgagtgccctgtgaaggaacgtgaatatcattctacagcatattagtcttctattgctgccataaaagttatcacaaatttaatgccttcaaacaacacaaacttattatctcactgctatataggtcagaagtccaggttagcttggttggtttctctgttctgtgttgcacatggcccaaatcaaggtgttggccagctgggctcttattgcaaggctctgggaggaagccacttccagattcctccaggttactggcagaagtcagttatctgcaattatagaactgaggtcctcgtttcctgggagagactctcagctgcttagggctgtatgttttccttatgacgttgtactcccatcttcaaactagtaatggcacactgagtacttttcacttttcaaatttttattgacttcttgtctgccacatctccatctccagtatgagaaagttctctgcttttaaggacttgtgtggtttgatggggtctagttggatactgtagaatcctctcctgtcttaaggtccataactgtaatcacatctgctaagttccttttgaataacattttcataggttccagggactagggcatagacactgtagcgggctactaggaaacactaagggttgcagaggaggggagtaactcaattcctaacgacaaatatttatgcagcacattcgaagttccaggctctgttataggtgctagatataattggaatcatccattaagaaaatctctttgggccaggcgcggtggctcatgcctgtaatcacagcactttgggaggccgaggcgggcagatcacaaggtcaggagatcgagaccatactggctaacatggtgaaacctcgtctctactaaaaatacaaaaaaattagccgggcgtggtggcgggtgcctgtagtctcagctactcgggaggctgaggcaggagaatggcgtgaacctgcgaggcggagcttgcagtgagccgagatcgcgtcactgcactccagcctgggtgacagagtgagactccgtctcaataaataaataaataaataagttcctcggtatggttttgtgttttttcttcttatttcatgttcgttgagcttcttgggtttaaaatttccattaagtttggaaacattttttcattaaatgtttttcattaaatgtctaaaaaaaaaaaaaagaaagaaagaaaatctctctgacattctcctaggtcagaaggagatacaggttgaacattccttatctgaaatgcttgggaccagaagtgttttgcattttggatttgttttcagattttgaaatatttgcagtatatatacttaccagttgagcatctctaatcccaaaatccaaaatctgaaatgctccagtgagcatttcctttgagcatcatatcactaaaaattttggattttggccgggcacagcagctcacactgatttaatcccagtatcttgggaggccaaggtgggagaatcacttgaagccaggagtttaagacgagcctgtgtaacaaggtaagacccttatatctttttaaaaaattagccaggcatggtggtgtgcacctgtagacccagttaccagcggggggcgggggtgctcaggcaggaggatgcttgagctttgagttcaaggctgcagtgagctataactgcaccactgcactccggcctgggagacagagcgagactctatgtcaaaaaaaaaaaaagttttgggttttggagtattctggattttggattttcggacttgggatgcttaacctgtaagcacctgtttgtaattaaactcgtgtccagtttcaggaacacgcccacacacccacacacacgcatgcatgcgtgcacgcacacaggaatagagatggaatgcattcaatttcctgtagggtctttggctgcattttcaccggcactggcacctgacaagaaggtaatgccaagcagataatattactgaaagcacggggtattcatgtctagttactaataattgcatttgcgatgataatcatgttgatgacagaatggaaaatggtgattgtaatcatcatcataatactaagctgaagcatgttattaggccaacaggtcaataggaaagaagcagaaatcgagacatggacgtggatgactgactggaatgtacacaagaaaccaagaatgtgtgggaatgtgaaggtagcagctgtcagctttgaccttgaagcctgactgagggaggattgtgacacaacgagatgttgtccagagttcctgagaaaggcaagatgctggcagatagatttgtctggaatcccagggtgactgataagatactgggaattcctgtcagttggtgaagaagtatctggtccagactgtacccttaaacccaacccttaggcgtgttcccctgcccatggccttgggcacttgcatattttgcaggagaaacagagagagaaaaagagacagagaggagacagagacacacaggtactaagttcacaggaaaaagtcagcactctcagcacctctcctaatgctagaacaacttcagaccccgtggtctgttccataaggtttttcttactgcatctcataaagagaagcagttagtctactggtcaggaatcacaatgccacatttgctagtgggcagggtcatggccgggggtgattctggcctccacattctgcctctctgtagctacgtgtctgttgatctgggtggtcattgtgttaacttcctctttcctgctttttaagtcctgaaagatactatctttaagcattcatctttctctctgcaactctgacttccaatctatgagttggcagccataaactctaattcccgggagcttcttctgattcccaggaggcccggatgtcctgctattttttcatagttgtcattgtgaggccttgtgacttttgagtaagaacagccacatatctagttagtaacatccgcagatgaggtttggcttcaagggagggtaagaggttgcactgcttagttctaaagcctaaactgagggattcagcccagatttagcagaggaactaagggtagcgaacctggggcagctaacgctggactgtaatttcagtggtgatttgccgttcctcctttggttgtcagccatcttaggaacctataatgaggggtgtagcaggggtggtgctggtgattgtcaaggaaggattagggcattcctgagccctcttgcaaattatcatcaaaattctaccctaattcctagcagactgatatgtttactcttgggaatgaaactgtatcattaaattcctttaaaaaacatcagcagtctgcatgtattatgatcttcctcacttcctaaattctttcatagccaaagacactcattcaaaaaggataaacaatagcagtgataataaaaaggaaacacaaaccctacatgacttacaaggtctcacatgatttactctgatgcctccccccatccccctagttccgacttgctcagccattgccacactgtcaaacacaccaagcaagctccagcctcctgtccccaccaccaaagggcttccctgagccagcagcatggctgccttcctcaggccattcagagtccctctcagtggcgcccccagctgcatcctccctgcaaagcaccctgctgggttccacagccaatttccttgcttattcttccctaaagcactcatccctacgtgacataaagatttacgtccatctcaattaactattcaatggtctacctctctcactcaagtagaagctctgcagggcagagattttatctgctttgttcaccactctatctcagctcctaaaacagtgcctgtgctccgtcaatatcactcaatgaaccaatgcccattttgcagatgtcaaagataagacttaaggaagcacagagactgttccccaagttccaccctggaaattatgtcagctgggacccatacccaggccaacatgcttcacaagtgtgattttctggtgggcaggaggtgacatcaagtgcatgccagttatttgaggtgactcccgttggagtgtgcagagttgggccagctcggactcagtttgtggcctacagtcgcccttgtctttcaccttcccggtcttgtgcacaccagtttgcagcatctgtcagcgaagcccatgggccccctcccctcctccattcggcctcttctgactgctccaccgatggcagacacttggcaggtggcctgaggcctgcagtcagcaagaactgcttcctgtccacttcccggcacaggctgtatttttagcttgctggtcctgggggggatcagtgacttccttggctggcatctcagggctgagctctttcccaccagttcagactcaccttgcagacgaaaaaggctttgagagtctgcccactcacctagcagcccattccagatgaggaaatcttgctcagtagaagcactcggcatctcagtgaaggcctggcccaccagaaaaatcatagcatgcctgtgtgtgtgtgaatattgaatgagtgtgtgtgtgcgcacacgcatgtgaataatgtgtgtgtgggggggtgtgtgtgtgtgtggacaggcagggtggggagggataaacacattaaaaatgtccaaataaatacaaaaacacagaaaaaaaataaaataataaaaacctacattcctaaatgttcatgtattagaatattcaaaattaggatgggtttgccacattgtatttgaaaaatcagactggtctcagtggctcacacgtgtaacttcagcactttgggaggctgaggcaggaggattgcttgagcccaggagttcgagaccagcctgggaaaacatagtgagaccctgtctctacaaaaaatttaaaaatcagccaggtgtggtggtgcatgcctatcgtcctagttacttaggactcgaagcggaaggctcactcgagcccacgagttcaaggctgcagtgagctatgattgcaccatcgccctgcagcccaaggaacagagcaaaaccctatctcaaataaataaataaataaatagaatttaaaaataaaaagcagtgttttgcagtttacaaaatgtttgatgtaacataatgttttctggaatcagaacaaacgagtttgaatctgatctccacccctgccttgctgtacaactttgggcaagttagccttcttatgccttagtctctcatctgtaaaaagaggctatggtgccttcatagggcagttgtgagcattaaatgaattaatccacttgaaagctcttagcaaggtgcttaggcaaaaataaatgtgtaatgaatgttagctatcaaggttatactaattaatttgattatcacaacaacattgatagaagcatgggtattagcctcctcatagttgataagaaaactggagagcagagagtgttcaaatgacttggctaagatcacaaagctattgcaccagagagcaaggacttgaactcaggtcagtctgattctgtttgcatccatttattcatttattcatttaggacattcttattgagcagctgctctgccagggctaggggctggtgacacagcagtgaaagtaacagaaaaaattccctgtcctcaccttatattctagtgcagaccattaataataaatataaataatacattgggagaggaaagagaaacactggcaagaagacagagtgccagaagttgagttttgtgttaaataaaggggtcaggagaagaataaatttgatcagtgatatgagcaaagtgaggtagcaaaacctattaataaggggcgggggagggggctttccaggcagagagaccagcaggtgcaaagaccctgaggctggagtatatatacagaattcaaggaacagcaagaaaattggcgtgcctggaacagggctagtaaggtggtcaggaaagaagatgagatcagagaggggatgacggaccaggtcacagcaagggtttaggattttattctgcatgagatgggaagatgttggcatctttactatccttatcaccaacatcatcatctccactattgtcaaggaagataatggtggagatgattctcctcctcatccccctcctccttcttcatcaacatcatcacacttggcaatataagatgttagggagtcaagtttgagaaaaatcatcagttagatgtattgttctgatttttaaggaatttcttaatggcaaagttttgttcccaaaagcctagatgtacatttgctaggatcgaggtggggttctggtgactggaggccagaggaccaggcatgccctaattctgtcctgatagtcgccccttcctgctcagggttcctgagagagttgtacccacacccaacaaaacaaaacaaaacaaaacaaaacaaaacaaaacaaaacaaaacaaaaaccgcacctgagaatcaaagtaaaacatccattgccctttgccctatgccaggggagacttcaaggttggggagagcctttaataatgtccctaggacaggaaggaggttcatcgaaggggagaaaaaggggcctttaaggggaacaggatggtgagaccaccacagcttcatctctccccacctccagagcttttagaaggtcgacagacctagaaacaaattttgctaactgcaatgaatttttgctacctgcagtggatagggcaaatgttcagagattttaagaccacagcttagatacaaagaaaagaacagtggttaatgtttccttgacatttacgtcccattgctatgagctgggctccacatgcttagacaccattctgccaaatgctctgcaaagtgtgtgaaaaagtgtcctcgcagccctctggctctcctgatggatgggttctgggtgcattaagatcaagatgtggaagcacagtccattgttgggggctaacactcagtagtaccacagatgaaccagaaactgcaagaggaaagcagtcctgggaagagaggctgtttggggtaagaagatgctgctggagctgggcactgtggattctaattctgcagaccatagtgaggggacatattgaaggagctgaagcggggctggtacagttatatttctgtaaatgtttttttttttttccaaatggaaaactcaaagttataatgtgatgagaggaacatcttgttcatcaaagctctaagaaattcaaatgctttttccttttcttttttttttttcttttcattttaaaggtccaaaatctttctcaggattgtaggaaggaaaaaaggcactcagacttccttttctattctcattgctacccatagtgcagacctcgccttcttgttctagaactactgtctccctgtatctcatttaccctccatatgatccagtctgcacatccagggaacagccctgcacccccaggtgaggacctactacttcctactactgggacctccaagaatacggccacctttgaaccccaaatgcatagaccctgctgttcctatcacagctccagctaagcaccagacactttgaaaggccagcgggttcagcactcaggatgctaaatgctgcaaagaaaaatgaggcagataaagtgatggagaagtgtgcatggaagtgccatttcagatagggggtggggggcaagcatttctgaggaggtgacatttgggcaaagcacctgaatacagtgagggcatgagccatgcggacacctgggggatgaggggcccaggcaaaggccttgatgcacttgcttgatattttaaagatttttatgtttttcattgtggtaaattatatacaacataaaatttatcattttaatccttttttaagtgtacattttagtggcattaagtacattcatggtgttgtgcaaccaccaccgctaaccatctccagaactttttcattaccacttgtgatggttaatactgagtgtcaacttgatgggattgaagaatgcaaattattgatcctgggtgtgtctgtgagggtgtttccaaaggagattaacatttgagtcactgggctggggaaggcagactcacccttaatctgggtgggcaccatctaatcagctgccagtgaatataaagcaggcagaagaacatgaaaaggctagactggcctagcctctcagcctacatctttttctccatggtggatgcttcctgccctctaacattggactccgagttcttcagctttgggactcagactggcttacttgctcttcagattgcagatggcctattgtgtgaacttgtgattgtgtgagttaatactacttaataaattcacatatatatatatatatatataaaatctcctattagttctgtccctgtagagaaccctaataccgccccccccaaaaaatgttatacagaacctgtccccctcccagcccctactaactttttttttttttttgagacagagtcttgttctgtcgcccaggccagaatgcagaggcacgatcttggctcactgcaacctccacctcctgggttcaagtgattctcctgcctcagcctcccaagtagctaggattacaggtgcccaccaccacgcccagctaatttttgtatttttagtagagacagtgtttcaccatgttggtcaggctggtctcaaactctgacctcaaataatccacctgcctcagcctcccaaagtgctgggattacaggtgtgagccaccttacccggccacccctactaatttctatcctactgtgtctcaatagatttgactactctaggtacttcagattactggaatcatataacatttgtccttttgtgtctgacttctatcacgtaatatcatgttttcaaggctcatctatattgtagcatatgccagaattccttttttgaggctgaataatattctattgtttggacatagcacattttgttcacccattcatctgctgatggacatctgggttgtttccaccttttggctattgcgaaccatgctgctgtgaacatgggtgtacaaatatctgttcaagtccctgctttcaattcttctgggtaaattcccagaagtagaattgctggattgtacagtaattctacatttaatttttgaaggaactgccatactgttctccacagtggctgcctcattctacattcccacatcagtgcacaaaggttccaatctctccaccttctcaccaacacttgttattttctgttgtttgattttaaggaagagcaagacagcccgtgtggatggatcagagtaagccaggaaaatagggtcaggaacaaggtcagggcaggctaatcaggaagggcccttaggtattgggaaggactttggctatggcttggagtgagactggcacctctggagagatggttttctacccacagaggggcataatctgatttacaataaggaagttaagcccagtgcttttaactccagaagcacgagggctccaagattagcacaatcctcttttctcccaagctgcccaagggttaagtaaacgcaaacatgggtaaatgcagtgaaaggagatatttccttcccctggctgacacacctgatgcaggaagcagactcgtgctctctgggaatgagaggcctggccggacttgtgcttccacaagaaaatgaacatcgccgggatgcaggatggcttagcacttctcctgtgagtttctgaaagctaccgaacagcctaaggccccatctgttttcaatcttgttaaaagggcctcatgtgctggcgcctatttaaaataatgcacacatggagtttttaaaatgaagaagaaaaaagccccgcgctctccccaccggcacagcttatgtgtttattttggagcaagctttggagcaagacacagctaatttctcttcccgaggttgatttgcaaatccccataggcttttgctccaagcatttaaggcagcttggtatgaactggtcaccctttcaaaagtctgctgtgaaatatctccaagttaagcctaggctcaggaaaggagggagcccaagggccactttgctccttgcaaataggttgtttccctgatcccttttccctcaatagagactcatgtttctaaaggctgaattcctcttctcagatgctcattttcttccacaggggctaccgtggttccaccccagcatgactcagatagagcttcgcgctaacccaaacctaatctccaaaacggggactgcaagggacagtgtcagggaaaagaacccacctgtggcaaatgcattccgcatcaagaagcaaaggcaatgaggtctgtctgtccatattctgaggagcacagaggccctctgcacttctgagacaacaacatgctcaactcacaatgacattcacatgtccagtgtccacaaatagctgtaatggatcatttccaaccctgtaggctcagagaaaacatcccgtaaacgtagcatcacttccacaaccacatcaacagcagctccacacatctcagggacttcataaacgactccccctagacccagagcaagggaagtgcaaacaggatacaagcaaaacaggataagtgtgtccggaatggcctcccagtgattgctcacgtcgctttctgcatcttcacacttgagtggtagcaatacccaagggtggtgatgacaataattatcccagccagtacattagtaggagaagtagtagttggagtctttggagaggtagaaacaaaaatggtgatactagtagtaatagcactagatgtggtagctgtatgaatactatccatagttccagtgacaatataataattattacatactatatttgtattagatttaaaatctatcatagttttgttttttgtttttgttttagcacttactatgtgccaggcactagtctaagggctttgcatgtagtaatgaatcctgacagtaacctggtgagacaggccttattatccccactttagaaaggggcaccgaggcatgatgagattagtatgttttatgagatcacatagcagggaggtgacagaccaagtatgcaaacacgagtctgaatccaaggtccctgcttttgactgtttcactaggctccttccaacatgcggcaaagtccgagacaatgggagcagcaggacgatagaaccccagtgagggaattacttctcggaggggcacagtggctcacccctataatcccagcactttgagaggctgaggcgggtggatgacttgaggtcaagagttcaagaccagcctggccaacatggtgaaaccccatctctactaaaaatacaaaaaatagtagggtgttgatatgggttggctgtgttcccacccaaatctcatctagaattgtactcccacaagtcccagtgggagataattgaatcatggggttagttcccccatactattctcatggtagttgataagtttcacgagatctgattgttttatcaggggtttccgcttttgcatcttctgcattctgtctttgcttgctgtcatccatgtgagatgggacttgctcctccttgccttccatcatgattgtgaggcttccccagctacatggaactgtaagtccaattaaacttctttgttctgtaaattgcccagtctcgggtatgtctttatcagcagtgtgaaaacggactaatacaggtgtggtggtgcacgcctgtaatctcagctacttgggaggctgaggcaggagaatcacttgaacccaggaggcagaggttgcagtgagccaagattgcgccactgtactccagcctgggtgacagagtgagacactgtctcagaaaaaaaaaagaattacttttcaagaggcagcctaaggagaggcctcagacactttttttttttctccttgagactcggttgctcaggctggagtgcaatgatgcgatcacggctcactgctgcctcgacctactgcgctcaagcaatcctcccacctcagcctccccagcagctgggactacaggcgtgtgccacaatgcctggctaatttttaaaatttttttgtaaagatctcactatgttgttgcccaagctggtctcagactcctgggctcaagtgatccttttgccttggccttccaaagtgctgggattacaggcgtgagccaccatgcccaacttcagatacttttttttgaggctcaaagggttcaggaccttccagctacgcatcaaacagagcagtaattttaattttttaatctgcttaaatattgggttttacataaaatttaattggaaacaaaactgttctattttgaaaaaccgttagaaagcaacagtgtgctgaggctttggagttagacaggtatcataactatgtctttcattgtctgtattctgatgctttgacccctgggccttgctggccctggagggaatgcccttcctaggttagccaagacttggagataccaaagagcttgcctggagcacgccctctgaatgcaaaccaaccaacgcaggctcaacctcctctatatatggggctgtcacactgcagggcactgcccatctgccctgatcaccccagggataggcaccaggcaactagggacagcccctactctccaaggccggttgaaataattcaaactcaccaatcctaaacctgtttcccctgccttgctcactcctccccacaaattcacaataaaagctctcgcccacatctccctatcattccctctgtctacgaacaatcatggtgctcccctgtgccccccgcctgcatgtggcatggggtgctgtgcctcctccttctaggggactgtgagtgtaagagctccttccttcttgacagtcatgcatgtgactgcgcgtcttgcatgctcaactaaaacaaatcctggttatgtttaagacaacaggctctgaccagcttcccccatgcccctcaggactttcgacaggtgtcaggcctctgctgggttgccgggtacaaagcctgggacacactgaccagtgtggatcatgtcacaaacagtgctgagcgtggggtcagacggacctgggtttcaattgcatttctagaacttcctagctctgggatcttggggaaatcacaggcccttttgcctcagtggctctacctgtaaaaatagggcataaggtcctgaccctgtccctatcctgaggctgctaacaggaactgcaggagagagtgaaggtgaagtttctccagagtgaagcccacaccaccataaactgtctttagggtacccaaggggctccttgcacaaaggtgtgtttttgagttgttcggtctagaagggggtttctcaaccttggcgctattgacattttgagctatgtaactctttgttgcggaagactgttttgtgtattgtaggaggtttagcaacatacctggcctctgcccacaggtgtcaggagatctcccctgttgtgacaaccaaaaatgtctccaggcattgccaaatgtctcctgttggggggattggggcaaaaatcacccctggttgttagctactaatacagaagaggagacaggttaggctaagcgtatcttcctctttctagcatctctctctctctctctctctctttctctctactcttccaaggatgcccaacagttcacagagtacccaggtacctctgtggtaaagtagggctctaaggagcatggttggaaaatacttgtttcagtagacactctaggctagaaaaagtagagttgtgttgtcagtgggttttggtttcacccccatcatatatttaccaactgagctcatctcatgatccaaccactttatccataatttaccatcctgtttaagtagcctcgtagcaaccccacagaatgtgagaactgcaagttcttttcaggtcatccagtgggtttggtcttgctgccagctctggctgctgtgcagagaaagataatgaggccgcccctcagctgggctggaaggcattgccttcattgaacagcggagggccgggggttgcacatgctctgtatatttcccagttcctccttttacaaatgagtcaacttacatccaaagttcccttagtgttaactaaaacagaccaaattctcaacgtgtgctggacatagtagcattgcggttactagctccattctgtgaatagagaaacattagcttggaaccttgaaccactcccttgaagtcccccaggtaacaggaggcaaagccacgattcaagcccttgtccatctgatcccgggtacagctctgtccatcaaaccaaagtgtctcaaaatatggcttcttcctactgaggcagcaaaaaaatgttcctccacacaaataaaatactatagaggagtcagtgagaaggagcctgtttacttttagaatctctttttttttttttttttttttttttgagacagagtctcgttctgtcgccaggctggagtgcagtggcgtgatcttggctcactgcaacctttacctcctgggttcaagcaattctcctgcctcagcctcctgagtagctgggtctacaggcgcctgccacctcacccggctaatttttgtatttttaatagagacggggtttcactatgttggccaggatggtctcgatctcttgaccttgtgatctgcccacctcggcctcccagagtgctgggattacaggcgtgagccactacgcccagcctacttttagaatcttaatgtaatttcccattaaatacatgcagagaacagttaaggtaagactgaaaagaaacccaaagccacgcggaagcagtatgatggggagagcagatgatatctcaggaatgaggcggcgagttagctgtgggagtgaggaggacacagtgttttatagagcatgggcagcttgggagccagacggaagccagacagacaggagttcaaatcctggctctgccaattctaagctgcgttgctgggcctctctgaaccttagtttctttgtctgtaatagtaacaggtaactcacaagatcactgtaagcagaaaattgggttatagatagtaaagtcttggcagagtatcggcatctatctatctatctatctatctatctatctatctatctatctatctatctgtctgtcttacctacctacttatctacctatctctctctatatatatataaatatttatctatcaatatagataataatgactcttaaacaatttctctctatatgggtataaatgtatatatatagatttgtatatgtatgtatatgtatatatacatttatatagagagagggataaatggcttaagatattattattgtctctattattgacattacaaaatacttttttttttttttgagacacagtctcactccatcacccaggctggacagcagtgatgcaatctcggctcactgcaatctctgcctctcgggttcaagccattctcgtgcctcagcctccgagcagctaggattacaggcatgtgccaccatgcctggctaatttttttttttttttttttttttcagtagagacagggtttcaccatgttgaccaggctggtctcaaactcctggcctcatgtgatctgcctacctcagcctcccaaagtgctgggattataggcatgagccactgtgcctggcccaaaatactaaatttaatgaaggtgtttaggggaaggaaaacctagttctgaactgattagagaccgcaaaacagaagcctggagagttaggttctagagagatggagaaagcataagtatatggatggatggatggatggatgactgaacaaatggtcagatgcatagatattcattatatagaaataacacttttggacaccaacatgcagaacttgagggaaagccaccataaacaagaaaccttataaattaattatttgcctcctccaatgtctctcatggggaccactaagcagagagaggaaaagagaggtggtgagaaaacgaggctggtgccaggttaggaagggccctggtgctgcctaaagactttggccttcatcccatagacattgaggagcctgcaccgtggagagctaagggagccagtgagagaccaaagcaattgtacaagaataagcaaattaagacgagtaatcaaaatctggttctgtccaatgaatgcaaagtttggggtttctggcacttggctggcccagcaaggggaggttcaggcccctctgctttcccttgcttttcctggcagcactagagggggtgagccttcccgtctcctccctgtctggacagaaggcaggccctgaggtgggctgggtggggagggcaccagttcagttccattttaaacaggccaagaactcacccattagctcacgacatgaacctcagggctgttgcttagggaagaaaggaaggttccagcaacatggcttaagaactatcgcaaggacaaaaaaccaaacaccgcatgttctcactcataggtgggaattgaacaatgagaacacatggacacaggaagaggaacatcacacaccggggcctgttgtggggtggggggaggggggagggatagcattaacatgttaaatgacgagttaatgggtgcagcacaccaacatggcacatgtatacatatgtaactaacctgcacgttgtgcacatgtaccctaaaacttaaagtataataaaaaaaaaaaaaaaaaaagaaaggtcagaaaacccagagaggctgtctgtggtccctgagaacatggatctgaaaaattgctttaggctgtaagaagcaggtcatttttcaagtctggctgggcaacaggtgagtcaggggaaaacaggtagacacaggttatgatcacaattctgccactaactaagcaatgacctattcaactttgccaagcctcaatttcctcatctgaataataatgagccttacacctcaggagttgctgaaggacgaaatatgttgaaaagttaaacgcatgagggcaatgaaaagcacatcactgaactaatagtttattttccttcttgaccatatactcagaactccacaagtacaacccttgatgccccatgacagaacttagctccatttcctgtctggtgctgaccttttattattgccaagttcttccccttaggatgtctaaagtcagacttggcaaggaggagacaaaggcagatggtagtttgactctacagtaaccagcagcatgacccaagcaagaaactgcacctcgatcagtccccattcaacagatgagatagaaaggtggtcaatgcaggggtcagtggtatgggctctggagcatctgggtccacatctcagctctgccatctcctagctgtgtcgcctcgggcaggacacttaacctctctgagtctcagttccatcagtactctgtggggtggtgatgaaaattaaatgtatacagataaactgcttagaggatggcttgcacattgtgtaaatgttaatgtcaaatcttgctttacctgcactgtactatatcaatgatttatctgcatgattcctgcagggctaatgctttgtttgtgttgtttaccatgccaaaggctctttgggttcttgcagtagcctaaagcttttctctttagcttctttcatctttccccactctggataagtttgagaaatatatattgaacacagattaggtatctgggtccttggagcacctattatgtaccgaataagtgtcctgccagcctccccaccacagtctaccatagcactgtgtaccctactttcacggcttctaacagtttgtaattatggtgcgtacgtgtgtgtgtgtgtgtgtgtgtgtgtgtgtgtgcatgcttgtgtgtgtgcgtaagagagagagagacagatagataatatgattaatttctggcccctgccattagatgttaagttccatcaggtagagattccatctggctttttcgttgttgttgttgttgttgttttatgatggagtctcgctctttcgcccaggctgaagtgagtggcacgatctcggctcactgcaagctccgcctcccgggttcgcgccattctcctgcctcagcctcccgagtagctgggactacaggcgcccgccaccacacccggctaattttttgtatttttagtagagacggggtttcgctgtgttagccaaggtggtctcgatctcctgaccttgtgatctgcccgccttggcctcccaaagtgctgggattacaggcacgggccaccgcgcccggccagattccatctgtttttaatcaccattgtaacctgagcacgcagcacataggcagtcaatgaatatttgtggaatgaataaagatactgtccctgttcccaatgagcccagagtctacagggagcgaggggcaggtgaattagtaatctcaaagtcatctgggaagtgtgatgtagacacaggtatgaggtgctaggggagtacagggaagaggcacctcaccctgcctggatggagggggagggcagaggaagcagcacagacatcatgttggagctaatgttgaagaatctatggcaaaatctaagaaaggatgtcccaggaggagagacgtgcataagcaaaggcatggagatgtgactccaagatggtattaccatgggtgggcactggggaaccacagcagtttggtgagaccgaagtctaaggtagagcacgggaggagatgagcaaggaaaggcaggcaggggcaagctcatggagggccttgtgtgcagagcttgagacccccaaaacaagtctaatgcacaggtcagccctttatgcatgagaggaaagtgaccaagccttccctggattttactgcttcaggatacaccttcccagatgagccagcataaagattaagaaccataaacaggcagggcatggtggctcacacctgtaatgtcagcactttgggaggccaagctgtggggaccacttgagcacaggagtttgagaccagtctgggcaatacagtgagaccctgtctctacaaaatattttaaaaattagccaggtgttgtggtgcgcacctgtcatcgcggctacccaggaggctgaggtgagaggatggcttgagcccaggaggttgaggctgcagtgagccatgactacaccactgcactccagcctgtgtgacagagtgaaacctgtctcaaaaaataataaaataaaataaaaagaaccataaacacagattcttcagttaaactgactctgaattccagttctgccacttgtatgctgtgtggccttgggtaagcctcaggttcctcatctggagaatgggggaactcatagtacctgttcatcagagtcatgatgaggatgaaacacgctaatccatatgaaatgcttagcgtgtgcctgacacttagtaagcatgtgattagatactgcctatgatcattaattccttcagagcccaggctgtacagctgccatctgcctcaggcaccgccagtggaaactctctcaggtcaccctctaaaactccctgagatgagggggccaagactggaccaaaacgggtccagtttaggttgaattctattgtaaagtaaatagtgccttagaactactaaaatcctatgtgatactaaagatagacattgtagggcacataaactcgttctctgctatcagcctcccagctccttcctgagggactagaaaatgcgcccagactgtgtatgatccaaaggaagtcatttcaatgcctaagtcctgttgatatgtcagctcactcccctcctcaggagactctgcttagagtgggctgggagattccttagacaatctaatagattagtttccagtttagcataacagccagacagatttttgcagtgaagtcatccaagtcaattaaaaggcatttttccctgctgtgagttcagaagtccctttggttcattccagttttctgggatgtttcataataggttccaccctaggttaattaataacccttgattcccactgaaatgcaaaggctcaaatccactgtgtaagcacatccgggcagaggctgctggcagggctggggtgagcccagtgggggctcctctcatcagggagtgggccagaccccaaatggtacagacaacagcagagctggcagaaaatgtagagtagccacacaaaagctgaaggccacgctggagaagtggtgtaaccaggggcagtagcgcatggggagggagatcatcaacagatgaaggaatcacaaggctggggattaggcagattgggagcaagttgacatgtgcagtgtgaaacggcttagtccaagtggctggactaaggtggtgaacaagaggaggttggcaatggctcgctttcaagaaatgccagctgaaacacatcatgtgggtctgactccatcctctcagtcttaagaaaaataggtcatctcttctcctccagtttcaaatacgaattacaggtatgagaatggctcaagtggttaaggaacacagtggcgaggatgtacatgcattcacttaacacttatgaagtcccttccatgtgcctcctacccaagcatcatattcaaggatgagatgacttttgcaccaaatccagagctgagcttttctgcctccagtctcaagccaccattcctatccagcgaatcttctaagaccactgtcagcctgtgcattctaaaatgaaatcacggtcacagcactccatggcttaaaaagttcaatacatacatcctgcctctaggacacaattcttagttgcatgccttgcactaatagcccaccctgaatagactgccctccaccttctttgtcagcttcgtctcccaccaacccttctcatgcatggcataccctggtcatttgccctgtacgtgacaagctgagacttgaatcatgctctttagctagaaggcccaatgtgcacatctgcccactcaccctcacctaattcttgtccccaaacccagctgcacatcaggttctctgtgaggtctttcctgagaacatcccaaggttagacaaatctctacgatagagagatcctcgtcgcaacacattttggccactgccttcaatgtctatcttcccaccagataaagaaccctttgagtgtggagggctctgtcattaggacaaagtacagagcaggtgctcggtgagtgcttcttgaatgaaggaacaggttcagataagacaagctctgtttgttttgttacacatccttcaagaagtgaaagggcttactaagttctccttcagaatgtccacttaatttccactggagtctcatttatcaatggtactaacagggggccgtgctgatgctgatgaagtggtgtggcagtaaggaaaggtgaatttccaaacacagcagctaaaggccaaggaactgagctgggtttcccagtgcaagaggatggactccctttgactcccatgcctccttccttctcatctccagtgcaggtgctgaatggtgccaccaaaccaggatgctgtactctcctccagcagaaaagaagaggagagtctaaagggtcatgcaacgggcaacacagtccatgttgtgttcagaatcagcggggctcattcaaccttggtttcagcattccccagccctcgctgcttggagctctcctttggctatcagctatggttcagcactctatcctaggctcctcccaagaagaaggcttctcacaggtaaacgtgaaaaacataaacttcatttgtttttgctatttttttgcttgctattaaaaccatcagaagggactaatggcttcttaaaagggaaaaacaaaagatggcatgggcagggggagaaatgcagtgtgaaaagcagggacccaggagatgaaagctagtgctctccacactttggactccaacaataatttcacgtgtgtgctaagtcacttcccctctctgaacctttcagctgttaaacaagggagcaggattagataatctcctaggacactccctggctctatccttccatgactatgtcacaccttcaactcactcacgcattcactcaacaaacattcattgcattttttcttcaggtccagagtctgtgctatctactatcaaagagacgttagaaatggatgacaggtgccaactgaatgttgtatatcaatgggaactatgattgaacatatgtgtaaataatcaaaacacacacacaaacataagctttttatattttttatcccacaaactgcactgcaaacttcttcagtgcatggattatatcctttctatttctgaatgcttcaagagactgaagcctagaaactactcagacaaatgtgtttagtgacgtgaagctgatcataaaaatagttctaatatttattaagcactttctatatgctaggctctgcttcaagtgcttcatgcagtcttatagtaacttatttcagtctcacaactatatgcgcacttactattttatatgaggaaactgaggcatggggcagttaaattaccacctcaaggttactcaggaagtggtggggccgggattcaaacctagttgatctggcttgagagtccaagctattatactatccagacagtctaaagacatagagcttagctgggcgtgttggctcacacctgtaatcccgacactttgtgaggccaaggtgggaggatcacttgagcccaggaattcaagaccagcctgggcaacatagcaagaccccgtctctatttggaaaaaaaaaaaaaaagatatcacgccactgcactccagcctgggcaacagagcgagactccatctcaaaaaaaaaaagaaaaaaaaaggtaaagacggagagctacgtttaaagacaataatgaacatcagcccttgggggaaaacaatgaaaaaatatagaattgttaacagagaaactatgcaggaataagccagaaacatgaaatgatgaataataaccattggggttagtcaggaaaagaggactgttttgctgggaaaacacctcatatgaatttgtaatttacccagtagatcaaaagagtagggtgagataggaagatactgtgggatacgtactcaagctggaaggggaaaggcaaaaagctttgtaaagacaaattcatgaccagcatatattctgataaatgtactttgattaagaactaagaccttggagttagccagacctgggttcaaatcccatcttcactgcattcttactagctgtgtcacatgcctgggcaatttatttaagctctctgggtcccagtttcctcagcaacaggcatactgtgtggattgaatgagttactgcatggaaaacacttaatgcggcacctagcaaatagtaaatgttcaataaactttgcttctatcatcaatgttattgtttctccattttctgtagagttcttaagttgatgagcctaaaggtagacccaggaagctgataaacctacattaatcaatgccatggttaggaagggaaacactcacttctctaatgagttatgtttcagctaatgggccctagtattccacctgctttttttatccccccagctggttcttagatttgaaaagaaaaaggcctccatggagacctgcacgcttttaaaaataatacaaaacagaacatctgaggtcagggtaagccaagccaaacaaataaatcttgcaggattgtgttaacaaaacaaggcttagtggatcagagcgggtagagttctgtccgactcagtcctgcagagaaacaccaagctctggtgaatttcaaacacaaggaggtcaaataggaagatcaaattatggagcacttcagagttcagcatccatgcctgggctgtaaccaggaaagcattctgtgcaggatggactccagaactcacgggtcacgtacagtcctagaaatcgagaccagaagagtcttacggatgaattctatgtgacctctatggaaagtaattttgcaatatctatcaaaattataaatgtgttctcttaggttgggttctctggaaagcagaccctgggatggatattagcctggggggaggtttattagtgaattccctgggagctccatcactggaagggggaagaaaagaaaggaagcaggactgtgagaatttgggccacacagccgtctcagcagaggtctccggcaactctgcaagaagctctgaagccggacagcccttcagagttatcccaaactggggtgatggggacagggatttattatagcctctgacggccagtcattggatgtaactgccaccaggaaggagatgtgaccttggaagaggcagctctcctcatctgaggcactttcaaggaggaatgacagaggaatgaagaaaagtccttcattcctcaatgtgcattacagcatccaccacctgcaatgcttttggaacaagttatcctatttctagaagtgaatcctacagatcgattaataaatgtttgaaatgacataagtttagcattgtctataatagtaaaattatggaaaacaaattatggtgtatccatatgacagaccccaggccatccttaacaagaatgaggcaggtctgcatatactctcatggaataaactccaagaaatattaagtgaaaaatgagggtgcagtggagtatggataaggagaaaggcatgtgtagatgccaagtagccaaaggggtggactgtgccagtcactgtctattgccactcatccttctatagtctctcctgcactatgggagctgaaagcctaaaatctgcattccccagatccttttgccacataatttcagctcatttctaccaatgggaggcattcatgcaggaattgaaggtagaaagaaggcagcaacaattctgcttctagtggtagttacagaagcttcaccaacaactatagcagtttgaacaagtggtggcaattcctgtagcctcagtggaagcacaggtctggctaagtgcagtagcccacacctgtaatcccagcactttgggaggcccaggcaggaggattgcttgagcccaggagttcatgaccagcctaggcaacatcgcgatgccttatcactacaaaaactaaacaaagaagaaaaaaaaaaagctgggcatggatggtggtgcacacctgtggtccaagctacttgggaggctggagtgggaggatcacttgagcccaggagtttgaggctacagtgaaccatgattacaccattgcactacagcctgggtgaaagagggggaccctgtctcaaaaactaaacaaaacaaaacaacagcaacaacaaaaaagagcccaggctcctcattcctcagtgacaatagtgacagtgacaaacagtgaatgtaggactgttgtgcctctgggtaaaatgatttccccttttgatccatttgtaatcaatcctccttgttaaattccctctgaaatacatagcatggttgatgtttttctaaccaaccaccctctgtgaaaagcatatatatgtatttgctcattgcatttaaaacttctctggaaaggtgcccaagaaactagtgataatagttaagtacatggaagagaactagattggtgcgggcagagtgggaggcagacttttcaccacataccactgtgtagcttttcaatttttaactatttgaatatactacttttacccccgccaaaaaagaaaaagattaataaaggttatctcctataagcacattaatttcctgtgaaatattccccaaggtagccacccagtttctgccacagcatttccagcacaggaggcgccctacctacaaaaaaggcatggcccattccttattagttcagcactacttaacagtttctgtgtagaccaagttgaaatccatcttcctgtaggattgcaccaatagactgaactcgaactccagtgaaacaatagagggtgatacttagcacagaaacctgggttcagattcctcctctatcacccatttctgctgcttgtttaacatctctgagccccagcttcttcatctgctaaaagggacaaagtacccatcttttgttagtttgtttgtttcagacagagttttgctcttgtcgcacccaggctggacgatcttcgcccactgcaacctctgcctcctgggttcaagcgattctcctgcctcagcctcccaaatagctgggattacaggcatgcatcaccacgcctggctgatttttgtatttttagtagaaacagggtttcgccatgttggctaggctggtcttgaatttctgacctcaggtgatttgcctgcctcagcctcccaaagtgctgggattacaggcatgagccactgcacccaactcaaagtacccatcttaaagaggcattgtgaggttgaaataagattatgcatgtcaagtgctttaatcaatacttttgcttattgttcttgatatttacaacactggaagaaaaaaatatacagtggataagaagaggaccctgaagtcagactggctaggttcaaaaacagacccatgccacttattagttgggcaaccttgggcaagacacttactctctgtgagtctcagtttctgaaagatggaggtgataacagtgcctacttcacccataaaatgcattcagctttatctcataaggactcaacaaatggtaacttactttatcaaccatacttgttcaagaggtagatatttgtaaagagtagactgggacctatcagagacctttcttcctccggactaaacatctccagttccttaaacgaatcctctttccttattggccttagtttcccttactccaatcccttttcagaaggcattccaggttgctgcaacccccttccagagcaacacacaactggatctcttattagagtgtctcactagcattgtgtgtgtgtgtgtgtgcatgtaagagggagtgtatgaactatcaccttcctgcattctaactgctgtggtttgatagtgcagcctgaagtgacatcaggttttaggggagtagcaatctcaactgtagtttattgagcacctaatacatgtgccggaaacaaatgttcagcatattacattaactcattttgtcacacaataactctagggaataaaatttatttcatcattttcaggtgaggaaattgatttagagatgttttaggtaaaaagcaaacacagctaaaatatgactgagctgagatttcatcttcagtctatcttactctggagccacgatcttaacccctacaccgcatttcctcccacacatattaagctgtgctcaactcaaatgttaggtctttttcgtttttctcatgtgatgttaacaagataggtctccccagctgggtgcggtggctcatgcctgtaatcccatcactttgggaggctcaggcgggtggatcatgaggtcaggagattgagaccatcctggccaacatggtgaaaccctgtctttactaaaagtacaaaaattagctgggcctggtggcaggtgcctgtaatctcagctgctcaggaggctgaggcacgagaatcacttgaacccaggaggcagaggtggcagtgagcggagatctcaccattgcactccagcccagcgacagagtgagactccgcctcaaaaaaaaaaaaaaaaagtctccttaatcctgctccttcacagctgagtttttgaactcagcccatcagcttaaggtcgtcagtcatcattttttagtttttgcagagacagagtctcacaatgttgcccaggctggtcatgaactcctgggctcaagcagtcctgcctgggcctcccaaagtgctgggattacaggcgtgagctactgcaaccagccgaacctgcactctccctctcactgaggctgcaggaattgccaccaccgactcgactttatattgtattcctattcaatttgatcacatcaaatttaatctggcgtattctctctcccatctagtttaaagtcattagcaaatgtaatttcataagtcactagtaagaaggaaaacaaagccaaggacaagccttttggcaagccattagatttctcccaaggtgtatttatttctatcaagtaatcatttcctaatgaggatgatgttcaacctgttaccaaaccaccaaactgaattaacatccaacttacacttctctatcttgttgacaactgtttcttgaaatatcacctggtctttatggtcaatatctacagctaaggtccattctaagaaatgtcccagaaagaattgtgggttgaaggctgaagtgcatgtgagaaaatataaatacggggtctgaagtgtttaaaatattttaaggggaatatctcatctttccattcagaagacattgatgttaaatacataaagggcagaagatgaacaggtctcccaacagcagcctcccctggacagtttcctaaccccatcccaacccaatattacacaaggacagtactcaaaggagcaactagtattcatatgtaaatccatgggtcgttctggcttccttcattggattgggagttgctcaagggcagggtttataccttctcttgccttttgctccacctgctagagcaaggcattagtgttctttctgccttggtacctctgtcaacacggaggaaagactggccgtggtgatttcagtcttctcttttaaaaattagagactgaggctctaccctagcaagtcctagtccactgatgtcccagaactgtgagtctacttaatattaatccattcatcaacctcactgcttggtcccacagaggggtgacttgtgcctgtggagaaaaagaccctttgcctcaaatataaacagaggagagtttgacatgccaaccatcctggcctgatcctctcagaccctactaggatactgctgtgagggccccgcagagccagtagggcattctgggtaatagaatgcaaaatgtgctgtctcctccacgggcctccccagggtttcttgattcctggctctgtaaaagttgaggcaagcagtttttagactggggggaagaggatggagagaaggggcggaggcttcctctaggccaaccacaactaactcattcgctctgtccagcaaaacccagacagtgcaattatctggttaatttggcccttggttgggagacaggatcccaaaatgtgaggccagctcagactaaacagtggcttccgtcctgagacttttcccaagtgctaaaggatgcatgtgagattcctggggggggggttgcttgtgtgttccacccattgatacagatgggcaaagacaagtgattctgattccaagatggatttggaaaggtatgtctactggggaaaaatgcccaaatgacctgctaattggtttcctggctaattcaccttctggctttcatagaggggcaggttggaaatcagaatgactctaaattagccaaggtttctcagtgtgattgtagacttcatagactggctgacgggccccagagcccctgggtgagttattcttagggcaattccctgatggtcctgctcatagattttgtactgacaagttgggccaatggcattgctaagataaaaggggaaaattaaaacatgcccctgggatttccacacatgggatgaggcagggtgagctcagctggcaaccaagtatctaccagatggtttatggaaaacccagatttttgaggggagattaagaagtggtagccatgtgtggtggcctgtaatcccagcacgttgggaggccgaggcgggtggatcacgaggtcaagagatcgagaccatcctggacaacatggtgaaaccccatctctactaaaaatacaaaaattatctgggtgtggtggcaggtgcttgtagtcccagctacttgggaggctgaggcaggagaattgcttgaacccgggaggcagaggttgcagtgagccgagattgcgccactgcactccagcctggcgacagggtgagactgtctccaaaaaaaaaaaaaaaaagaagcggtgacttatcgcccctggaaactgacaagcagcctggaatctgtagaatctatcagttattcatcctgcaaatatttccttcagttctcttttgtgccaggcccagtgctacttagggtaagatccagacagtcatagtctccaccctcatgcaaatcgtcccactcaaaatgtgtggctagaaactcagataagggccaggaagaaaaagttgaggagctatgaaagggaataaccaggttacctgatttaaatctggaaagactcagagaaggagtctttgaggaaaggattgtaaagctaacacttcaaagaacctaatttgctttttgaggaagatcactctagcgttgggatgaagaatacattggagatgggtggaaaacatgaagttgtgaggctgttgatgaggaagactggacgagagttgagggtggtccagccaaggatctaggtgatggggatgaagggagaagtggagggaccaggaaatatcagatgcggagtcagcagggtccagtcattgaatgggtgcagtggtacagggagaggggcacatccgggagccagagcaggtttctggctaaggtggaaggtagatggccacactcttcattgagagagagaattagggaggagtagggtgggcgcaggggaagatgatgtgtcctattttggagaaccacaccgcattccctgtcactccataccctgtacttctggtctccttatctttgctcacactgcctcctccattcacacgctcttcacgccaccatctccacttgttgacatcctatccattctttgatctatttcaaacaccactccctcctcgaggccacacctgagtctttcagttgactgtgacctctgctgccaggagtgctaagtttggacctctcatccctggcttctacctgtaagttcaaatcccagcttcactgcattcttactagctgtgtgacctgcctgggcaatttattaagctctctgagcccaagtttcctcagcaacaggcatactgtgtggattgaatgagtgactgcatggaaaacacttaatatggcatctagcaaatagtaaatgttcaataaaagtgtgctaccatcatcaatgttattgttctgtaggccaggtgtggtggctcacgcctgtaatcccagaactttaggagaccaaggcaggtagatcatttgaggtcaagagtttgagactagcctgaccaacatggtgaaattccatctgtactaaaaatagaaaaaaaataaaaaataaaaaaattagccgggcatggtggcacatgcctgtagtcccagctactcaggaggctgaggcagaagaatcacttgaactcgggagacagaggttgcagttcactccattgcactccagcctgggcaagagagtgagactccatctcaaaaaaaaaaaaaaaagaaagaaagaaaaagaaaagaaaagacttagctcacctctcctcctagaccacaggcatttggagactgggcctcttcttctatatactcgttctccacatattagctagctagcatagtagactcttgacaaatatttgcaaaatgaacaaaaataacctgttctctgccatggaaggaaaaccagtagacattgggttgacttgaaagccacagaatcaaattgaaattcaaagtgtaggtgttttaatattaagccaacttagtttgcttagaagacctttctgtttctctgacacggtaagctcaaaaagtgcagggagaagaacagtcatgccccccattttaaaaattgtattttgaaatcatttttacagcaaggaccttgtctatgttatttactgtttgcctttgatgatgaggaggaggaggagtaggaagaggataaagaataatgatgctgatgataaatgggtaacatttactaagtgcccagtatgtgccaggtactgttcaagcacttttcatggactaactcgtttgatcctcacagcaccctatgaacacaggctgatgctattattgccccagttggacagatgaagaaattgaactggagggagtgtaagtattgctcaaccaaggtcacaaggttagtaaggggcggtgttaggattcaaacctggagtatggctccagaacctatgctcaaatgtgctctcctaaggctgagcacagtgtttggcagagaggaggtcctcgcggaacgaacaggagaaagctttgatctggagccaggagaccacaccttccactcctgattctgccactgcctccctacacagccctaaaaaaatctgtgtttctttccacataaaatgagggacctggatattgatattaatagcaatagcaagagatagtatttgcaattctggtcccttctgaggttttaaataatttaatccccacaatgatataaggaaatcaaggcagagagagattaagtcacctacccaaaacctagaaaatgagagaggcaggattcaaggcccttcattatgttcctaaactatgctctctagcccaggtggctgcaaggagatgccccaggggccaaaaggaacggtatagaacagacagaagttgggctccacctgcccatttccatcagagcagctctacgtgtctctcttttgtagaatgagttcctatttgacatttcccttgaagaaagggtctctgctaaaacataaaaggttggaaaccactggcccaaacaattctgaaatttaatgagactcccaagtataagcttggacttttctggtaatcttggctcattatgaccacataagatggggaccaagattgcatgtaagaacagccccagcggcagaaaaggtcagttgacagtgctaaagacacagctcccacctacctgctccactcggatctcaatctctccattcaccttcttcccatggaaatacttcgacctgtaaaggggaagaaatcagctgagtaaggatgcaggctgttttactcttttctcccttctcccaaaggccttaccccagaggtgcatattgagacacatcctcagccatcctactgtctcctcccaccttcactactgattttctcagtcttttttttttttcttttgagacggagtttcactcttgttgcctaggctagagtgcaatggcctagtctcggctcactacaacctctgcctcccaggttcaagcgattctcctgcctcagcctcccgagtagctgggattacaggtgcctgccatcacatccggctattttttttatttttagtagagatgaggtttcaccatgtcggtcaggctggtatcaaactcctgacctcaggcaatccacccacctcgccctcccaaagtgctgggattacaggcgtgagccaccgcgcctggccgattttctcattctttataggtggtgtgtggtagaggggagatggtggataagattggaggctcaagttctagttctgtcacgtcacttgacctctctgcatctcagttttagcatctgtaaaataatgatattaataattttgctacaggccgggcgctgtggctcacgcctgtaatcccagcactttgggaggccgaggcaggtggattgcctgaggtgaggagttcgagaccagtctgaccaacatggagaaaccccatctctactaaaaatacaaaattagccaggcatggtggcacatgcatgtaatcacagctacccgggaggctgaggcaggagaattgcttgaacccggaaggcagaagttgcggtgagccaagatcacgccactgcactccagctgagcaacaagagcgaaactcagtctcaaacaataataataataataataataataattgtgctacatatttctaagggttactttgaggattaaataagaaaaaggatcccacataaaaaggtctgaaatgatggctatgctgactatcctaatctaatcattatacgttacatgtatcacaacaccaatacgtaccccataaatatgtaaattattatgtatcaattttaaaagaattaaaggatgtttatagtgttttatccatatttttcttaaattcatgattttcatcatgttatcttcacatatatgttaatcctgtctcccctaccctttgaaggcaaaaccacacatggtttatcttggtatcctccaaccctccaatttagtcttcagaaatatgttgaatgtataaaagaatgatgattgctagaaagtgtgtaatttaaagactttagaaaatacagttttgtttgatccagtttcattctcaagtatatatgtttgtgttcttttaacattaaaaatgttatggcattttaactctcaacaaaaatcaatgttttagtgacgcccattatccaaatcttctaactattcaaaaaagggaatcctacaaaaataaataatgcagtattgttttattgagttatacctatatgccccacatactccaccaaagatttattattgatctatccagtctcacccatttctctatttttctatttgtctaataaagcagtcctcatttgttcctttgtctatctgccatccgtccgtccttccttccttctttccacagacttccttctacatccctgcctctgtcttccccatcatcagtacatgacatccctatctacccattgtttagacatcatccctacactcactgattctacattttaattatttctcaaattcatttacctggtgatttttctccataagcaccctaatcctgacctatgattcatctctatactgagagtctcttcatattgttttcatactatttattacaacaataattataattagtaactgtgtttaatgtctgtgtaccactaaactataccacagctccttgaggtcagaaataacctattgtattcatcactttcttcctaacacctaccagagtgcttaacacatagtaggaaattgattaatatttgttgaatgaatacatgagtgaatggactgatgaaaaaacacttgttgagtatcaactcttgtgctagaaactctgctatagagtttaacctacagcctttctcattaacactcacaaccaccaccacgaagtagatatcattatttccaacttacagatgaagaaactgaaacccagagagactaaatattttgcctaagggatttgaacccaggacttctaattccatatctgtgcttttgctcaactctgaaaaatagcagtgaaaattggggtctttataggtttggatatcgtctcacaaaaagtaacaaagtttccattttctctttttgattattggtatgatgacactaatagttcttggtgacttgctgtgaactgagcattgtgttaagcatttccataaaccttctctgggacggagacagctctttgcttcctaatactcattctccccttttcccacagtaagagagttgacagattggtacataaaaatgtgtaccccaagtctcccatcagctggatgcagccacatgatttatttctaatggataattttttaagcattaaacaaccttcttagtctcctactcttttccttggaagatggatgtcatcacccattatttttcagccttccatttgtgaaagaatcctttctacaaattcactaactgcttcagcctgtctgcttccaaagtctctctacctactcttagctgatgctggtggagttaatctcttcccaaaactgactgacagctctgatattagcaccactttttcttacgtcctgatgggcttagatgtcaactaggcggtagtttagtaggaaaggaactattagtatgactcgaaagcaagattttgattttttttttctttcagcaatggtcttcaaataaatacccatgtggacagcctcatgcaaagagaatcttttcatacagtttgtgaattttatcgtaatccttaaaggtagtatcagcaaattccagacaccaggacaagcccatgtctagtatttgaagtgcctggggcaaagcgacaaatggaaacctatgggtcatatgtctaatatttaaaattgacaaaatcaagccagcaaacatttaaataaaagacatctgtccactgggcatggtggctcatgcctgtaatcccagcactttgggaggctgaggcaggcggatcacgaggtcaggagttggagtccagactggccaacatagtgaaaccccatctctactaaaaatacaaacaattagccaggagtggtggtgggcgcctgtaattccagctgaggcaggagaggctgaggcaggagaatcgcttgaacctgggaggcagaagttgcagtgagccaagattgcgccattgtactccaacctgggcgacaagaatgaaactccatccaaaaaaaaaaaaaaaaaagaaaaagaaaaagaaaagaaaaaagaaaaaaagagtcccaaagagtctgtcttccttccttggcagatacaatttcataatgaccttaaagactcagaatgtaaacttctcagaattctttgcactctacccagcacgtggcagcacaaggattgccagctcttggttctcagacctcacccaagatcttccttaattccccacccactctcctctgcaccactgaggctcctggtgcgggtatgtggattgcccagaccacgtggccaagcttcatctactcccttcccctccccaaatggttgtcctttggccaccccttggaaaatggaccaaggaattggcctatataggctctgaagttgggttaaggtccctttgaggagggaattctagagtttgggtacccagggcatggcctaagagtgcaatttgtagggtcttggtgggaatatcccctcactcctaactcctctgcctgtcaagagaggtgtggctaataaggaccagagcaggatccaaggtaggcatctttcgtggatttaaaaatcacttgcttttaaatccaagctccaaatttaaaagaagtactgggtgggcctgggaccgggaatggtaacctatcattacaatcaccagcatactgggaaaaaaaacatggatttgcaatcacacaggcttgggcaaaatcttagctctactactcactgaccatgtgttctaagacaagacacttagccctctgggtctcagtttcctcatttgtcaagtggtgacagtaactaccagggaagggtgtggtgagaaagtcacataatcctctatgcaacaaggcagtaaagtgcaatggcttcagggcatacagcctggataggaccccaactcctccactcacttgtgcaagcttgggtaagccaacctctgaatgccttagtttccacacctaggaaatgaggctcatagtagtagccacctcacagggttgttatgaggattaaatgaaacaaggcatacaaagcactgagaatagttcctggcacacagtaagctgcaaagtatgtagtccatggcctgaaacagaatccacaagagcaaagagctatcgagtgcttaccctgtgcctagtgggtgctgtgtgctggggacccacaaataaacaaaacaatcttaccctcttgggggttccaaagcagaattatgactcaccttgctttgatctgtctcacaggtgcaaggagtgatggctggtgatggggaaaagaggtggccttggcctataaggacagccagacccttcacatccttcctcctatttgaccctcatgccaaccctgaggggtggtagggcagggattgctcccaacgtgttccagatggagaagtctctgctcaaagtcacacgagtgatctgggtacccaaactctagagggaagaatttgggtacctttcctggagaccctaagtggtctttcagactttttggatccagtccagagccctggcgtccttcatgatctggaccctgctgactgggggtctgcttcccctccagtttgctgtctatttcatggttgcatccaaattcctgtgcttctctaaatactcctgtgctgtcctgcctctgaacctctgcacaggccttcacctctgcttggcacttccttgattgtctctttctcatgtttcaagatcctatgagtgatatctactctgctgagttttccttgacagcacccccttccctagctgggctgagcgtcctcccttggttcctacagcacgctgcacttacaaccattccagcccttaccacttcacgttgtcattacacatcacttagctgccctctgcccccaaacatatagtctgtgagctcctggaaaccagaaactgagtctccatgctcactgtgtctccagtatccagcacaatgagctagggcacaggacaacaggcttaacaaatgttcgctgaccgggtaaggaaatactgtctgtaggccggcctttcctggagacacttgactgccatctactggcacaccattgtaatacagtcacaggtctacagccactgcgatgtgggggtgtgtacgaggccaaccttcgcaactggcattcctcgacttgattctaacctggaacctgaagcactttgcactacaccaataccacccaagcagctgtggtcttgatgagacctcaccttcccaggagaaacatttgttttgcccatctctggaatgtttactgcagggcctggcagacggactggggctgaagctgagggtcagggagtccatccccccgcctggctgcaagtcagaagtctgtctcctgatgggccacacagactgctgcctccttgccgggggctcattcaggcttcagccgcctctgaacggttctgtctggcagagggaagggtagggatggtctggaattctagatgcctttgggggctggggttgctgcctctgtaattgactggctgtttgacctcaggcaaaatggatggacccgctgtgcctaagggctctgtctctcatggctgcctcctcttcccaccctaatatgttcaatctcataataagctccctgaatacctcagccaatcaatcaagtccttggcctgggggagctctggattccacgaagattctctctccgtgggtggtctcatattttactgccacatctgaggccccaggaagaagaatattataaaactggtgctgcctggggtgggaaatccctagttgagggaggtgggaagtgtgtatgagagagactgatgaggaatgggtatggggctcttttgtggctgcagcaggggcagaagaaggggaattcatacaaacaggatctgtgttcaaacaggactgttttccaataaatcgatcctgtatgtagagttaacgcagccagggcttggtgatgtccttccaaggaaggagaggtcaggaatgtcctgtcccagggacagctgtctctccgcaggccacccccactgggggtggagtggaaatagagaaagagattttcatgtttctgatgcaacatgtcagttgctgatttgtggcccaggcagaagcagggaagacaaccaatgggctgtgcagaaaatgaaggcaaaacactcagagactttgccagttagcaagagagtcacgtggcaggctggatgggcagagatgtggcagaagaaagaccttggaacgcaaagggacccaagatctgattctagctccattgttttctcctgagaacagctcaccctcctggcaccttcccattgccagagggaggaaccgccccctcaaccgcaaacaatggtgcagcctctcagtcctccatgcaattagcaaggtccaatgaactaggaagggaaggaatgcactaagagtgatgagactccctatgcctgtatggggatctgcggaggcaaaaaactgagacataacagggccccgagccacaggatgtgacaaatgatccccaccttttgcctctgagaacaatagagaaggagatttttgtgggcaggatctgatcacaattcacatcacttattcactccctcattcaatcactatttattgagccttatgtggactaggcaccacaccaggcataggagtagatacagcagatacagtggcagatgtagtccttgttcttggagagcttacatgcttattgaaaagacaaaaaataaataaataaacagataaaaagaatgagtactacgaataaaatgcacgaccaatggaattgaggataagatgtggggtgcaggggagattggacttcagttggtagaaaaggcttctttgaaagacactgaggccgggaacagtggctcatgcctgtaatcccaacactttgggaggccgaggtgggcggttcacgaggtcaagagatcaagaccatcctggccaacatggtgaaacgccatctctactaaaaatacaaaaattagccaggcatggtggtgcatgcctgtaatcccagctacttgggaggctgaggcaggagaattgcttgaaaccgggtggtggaggttgcagtgagccaagatctcgccactgcactccagtctggcaacagagcaagactctgtctcaaaataataataataataataataataataataataataataaaataaatagataaaaagaaaagtactatgaataaaatgcacaaccaatgtgattgaggataagatgtggggtgcaggggaaattggacttcagttggtagaaaaggcttctttcaaagacgctgaacatacacagatagaccacctactatgtgccagagtctgcaggctttaaggaaacaagcgcaaagacaacatagctagctcttggtctcagggggcttactacctaatgggagggacagacacaaaaatagaaaatgaccacacagagcattcacacaaatatccccctcagcccacagaaaaagcagccaactcagtctgaaggtcaggggtcaccttcctgaggtcaccgtccacccatccatccaatgtttggtacctagtctttgccagggctgcaaagatgagtgcagcaggatctggatgtgtgtgtctgccaaaaggacacgggcaagggcaaaggaagtaggtacgtcctgggggcacccaggagagaaatgaatgttcctgggtgtgtcctttaatgtacaacaggcacagagcagaagacctgggtttgagttggcagctctggcacctgctgcctgattttggaccagcctctgcttcctcttccgtagatggggataagaagatctactcacatgttgtcaacaggattatatgaagacacagatttaagggcctctgtaacctgccaagaatgtgctagcaaatgagctgctccccgatgggctgcaagggtagaatttgatctccccaggtaaggaagtgcgtgagcaccactagccttggagacaagcccaggtccctttcagctatttatttccagtgctgcctcaggccagtgtcaaccttcctgaaccttggtttccttaactgtaaaaataaggacattactatatctgctgtaaggaccccatgaatgatacccctgacacatggcaggtgtttaactaatgttcatctctttccctcctgtgcatcagcatgatgggtggagggtcgaggtcagctgggtatgtccctaagaacatgacaggtcattttctctctccaagaggaggtagatggcagcatctgccttgctctaaatgaaaccttgcttggtgtcgagcatgatggagaccttccctgtctaatccctgggaactcccttcctctccagcataggcctttagggtaaataaagtcatcagggccgggcacggtggcttatgcctgtaatcccagcactttgggaggccgaggcgggtggatcacctgaggtcaggagttcaagaccagcctggccaacatggtgaaaccccgtgtctaccaaaaatacaaaaattagccgggcatggtggcatgcgcctgtaatcccagctactcgggaggctgaggcaggaaaaatgcatgaacccaggaggcggaggttgcagtgagccaagatcaagccactgcactccagcctgggtgacagagtgagactccatcttcaaaaaaaaaaaaaaaaaaaggcatcaaacacccactccctctacccctctcctctctaaagacacagcactatgtcaccctcattcctacagatgtctgcaagttcacactcttcataccacagaaagggttaacgtttggaaggctacatcatgccttcagcaaacacttattgagcatctactaagggcccaactggggaaatccccacaggaaaggtaatatactaaaaagtaattcatgccaaggtgcaagtgactaacatctgatcatcccagaaaagggtttttgatggcataaggaggataaggggatcacggggatattgtgtgtcttgtttggcaagggaaagtggagcctgtcaaggtgaaaagtgcagagcaccaaaagagaggctaagaccatttattatccattcatccacccaactacccatccatgaatccatccatgaatccatccatgaatccatccatccatccatccatccatccatccatccatccatccacccatccatccacatattcatccatccatgcatccatccacccatccatccatccatccagccatccatccatccatccatccatccatccatccatccatccatccatccgcccacctacccacccatctacccatccatccacacattcgcccatccatccacatatccatccatctaggacatactatattctcagcactgtgctacataggcccttgaaattgcactgaacaaaacagcccccttgccatcctggtttttactgtctagccaggagatagtcccagaagaggaactagaccaaatagttactctgactcctgtcttctttatcagaagctgccaactagtagacctcatagaatccacagtcttgttttgttgcacttaaattgtatacttttaaaatagaatattcgctggcaaggtgactcacgcctgtaatcccagtactttgggaggctgaggtgggcggatcactggaggtggggagttcgaaaccaacctggccaacatagcgaaaacccatctctactaaaaatgcaaaaaaaattggctgggcgcagtggctcacgcctgtaatcccagcactttgggagaccaaggtgggcagatcacaaggtcaagagatcaagtccatcctggccaacatagtgaaactttgtctctcctaaaaaaaacacaaaaaatattatctggacgtggtgcctgtagtcccagctactcaggaggctgaggcaggagaattgcttgaacccaggaggcagaggttgcagtgagccgagatagtgccactgcactccagcctgggcaacagagtgagactccgtctcaaaaaaagaaaaaaaaaaattagccgggcatggtggtgcatactaccggggaagctgaggcaggagaatagcttgaactcgggaggcggaggttgcagtgagccaagcttgcaccactgcactccagcctgggtaacagagtgagactccatctcaaataataataataataataataataataataatagtaataatagaacattcatataaaaattcagatttctgacttttcttgaaaatcaataactcgacaacaccaggcccttattcccacatggtaaaaactggctgcggggcctgcagctgctgcctcagaggaggcatcggttctcacgcccaacacagttcccagtgctccctgtcatctctctgcagccgaagccaagtggcagatatcatctgtcatagagcctatgctgctgtttttcttatagcagggaaatatttctctatgcctgtgctttttcctaccacctgccccttcactcacggactgatttgtcccctctgagcagctgcacagacaacccctaatttcgctaagcctattctgaagatggcaattagcttagtgcaaatcttcaggaaacccacactcctgtcccttctgcaaacccagggcagaaagtcaggaaaatggaaatgaagcaccatcccttctcctgccaccacagatggcctctctcctgtcgaagatgcacgtcccaggcaggcctccacaggccccaagggcttcctagacgttctgtaatgaggctggcatctgcccagagccctgcctcccccagggcaaggctgtaactcaggcagaaatctactccaccccaggagtagctattgctcaagaagacccgtgcatccgagggactctttggaaaaaaggtcacttggagggcctgggccagaaaaccaggttgtggaggagaaaacacgactcacaagtgaaacgctgaaactcctcagactttgcccaaggcaagggcatgagaagtgatagagaagacatcagagagaaaacaaaagacttcagggccgagcctcccttttaaaggcttgcagcctgaccctttcatggtctaagccccattatttttcccaaatgggtagcccagctgtgtctgaacacctgcacctgaggggagctcattccctcaccaggaagcccactcagtctctggatgactttgccaattagatgaattttctgtatactgagcttaaatatgtctccctctttgttctcccccactggttccagttctaccaggtgggagcgtcatgaaacaagtcctctagcttggggggtttctaaacttggccttacaccacttaaaaaattcatctctgccaggcgtggtggctcacgcctgtaatcccagcactttgggaggccaaggcagttggatcacctgaggtcaggagttcaagaccagcctgaccaatatagtggaaccccgtccctactaaaaatacaaaacttagctgtgcgtggtggtatgtgcctgtagtcccagctactggggaggctgagacaggagaattgttcaaacctgggaggcggacgttgcagtgaggcaacatcactctgctgcactccagcctgggtgacatagcgagactccatctcaaaataaaaataaaaataaaaataaattcatctcctgagctccagtctagatattctgattccatcattgcaggggaacatctccgtgtggcctgtcctgtatccattctgccttcttctggtaacagcagttctatttgcatttgcattgatggaagcaagccttctttttgtgcagtcctggtgggactgtcccaaagtgcccgcagagcaaggagtagaacaagccgggcttgttcttccccaggaatttgatttttgaacagagagaaacaaggatgaaagcaagcaggagctgatttatcccgagactgttcctgccacctagatctgtagaggggcccagggatccagggacccaatggccccatctttctgacactcaagctgatgtatcctgagactgttcctgccacctagatctgtggaggggcccggggatccagggacccaacagccccatctttctgacactcaggtctccctattttcctttgcttctgcaagcttccccatacattttcaataaatctcttttgtttgtttgttttgttttgttttgagatggagtcttgctctgtcgcccaggctggattgcagtggcgcgatctcggctcactgcaaactccacctcctgggttcaagtgattctcctcccgagtagctgggactacagcatgccgccaccacgccctgctaatttttgtatttttagtagagatggggtttcaccatattggccaggctggtctcgaactcctaactttgtgattcacccgccttggcctcccaaagtgttgggattacaggcgtgagccaccatgcccggcccaaagtctatttctttttcatgcaaagaactgtatccaacacagagggtgtagatggtgcctgggaatctgaatgtcattgtgatagaaagtcttttgggggccatgctcctaggccaacctcactgtttcacataggagaaacagaggccagagaaggtgatccctcagcaccagcctcaagaccccacagcatctgcagagttctttagaaaggcagccaagaagagagaaatttaggaagaaacagcacccatcagatttctccccacactctcttctgctcaaagccatttcccccagattttctagctcctgtttccgagggtgaagctctcccctaagactccactagggcgggggtaacaactcttcactgttcccccctcctccccgaaagagctgggtaggaagcagcaggggcaccgggccgctggattggacagcgtgtagacctcacggagaggggtcagcacttgaaaaattcctcaagtcaaagggctcggggcttgggtgccgcacaaggccctcactgtgtgcacattgtctccctgataaaaggggccgggcctgggaaaacggagctgtctccaggcgacggggtaggctgctgaggaatgcccaggacccctccctcccccagacaccagggccaggactgcgagggggtagggaggggcagggggtgcagcgtgggtgcccagagggagaggaatgaagtccagagcccctccaggtggtgttgggtggtgtgtttgagtgatggaatgaagcaagcagaaagtgacaaaactcccttcattaggcccttcctatctccacccccagcccctccagccatcccagaaaccccttcatttccccacacaaacaggcagggcctgcccttgttcaaggagagccttaggggtaggggaagcggtggagagaggcacaaggattttgttcctcagagccaagtgtcttcaacagagagttgtgtgtctccactctaagcctctcaaccaactctaggaggaggggactgacttggagtcggcacctcatcctcacagcggagggactgccagcccgccaggatctcgacaccctcctctagggtttctggaagacagccctccagcacatccagctgagctgagaggcaggccaaatggcttccttccccctggcttccacaacgattatactcaccagcaattagtaattgcaattaattgttaataacagttaccatttcagggcctcttaggacagcctaagccgtgtaccagctccacccatgtcattatctctaatctttccagttacccttccaggaagatattccatgaccctgccttcctgctgaggaatgtgaggttcggaggttggatttgcccaaggtcacataactgagaaggaaaacagggaccagagcccacagtacccaggccgtctggctctggactgtcccctcagctttgctccctccctccctgctggtggcggacagccctcctcacaggcaaggaaagctgctctctgagaatggggtcaatagggggatctggtttggctcttcccagccagaaaacaaggaagctctaaggccaacctctcactggccccgtggtagcagagccagcagtgtctcttgttgctgccctccataagcagagaggccagataaaatccaggacatccaaattttccatccaatccaaatttccaatgaacaatacatcattttgtagtataagtctctccaaatatggcatgggatatacttagactcattcattgtctatctaagtattaactgggtgtcttgtatttttatttgctaaatctgacaaccctaccccaagccactgctggttgtgccagctctgagttcaccccccatccttcctccacgtggcacaggtggacgcagcatgtcctgatcaccacagggctgatcaaacccaatgcagtccttacaaggacaggccaagatgccctgcagtcctcatgccttcggtcaaagcagactgaagctgcttttttttttttctgagatggagtctccctctgccaccaggctggagtgttgtggcactatctcggctcactgcaacctccgactccctggttcaagtgattctcctgcctcagcctcccaagtagctgggattacaggcatgcgccaccacgctcagttaatttttgtatttttagtagagatggggtttcaccatgttggccaggatggtctcgatctcctgaccttgtggtctgcctcccaaagtgctgagattacaggtgtgagccaccgcatccggcctttttttttccccctgaaggaaacactggcctctgagttaccagctgcaccagaaggaggaggggaagccttggaaataacatgcaagtatcaggtactctccctgaattccagggcaactgaatattttctaagactctcttccagggcatcctcaatcctgaatttacccttaataatggtaacagactttggcaagagtatccattcattccttaagtcatccatctatcccagcctcccgtccatctatcctagccaggcactgtgctgggctctgagggtcagtggttgcataggaaaggcataaactctgaccttgagtcagagttggtccaatatgggtaggaccaaacaaagtcactcacatctacattgaaaaactaagcacccacactgaaaaacagctgtggaggagaggaactcggcactctcactggacacttcataacatccctgtgaagtcagtggtatagggaaggtggtggcattgtgatcccactttacagacaaagaaactgaggtaccaaaaggtacagtatcttggccaagaccacagagacagtgagtggctgggacttcaagcccacgctaccacctgtcagcctagagttctcttgagtattatcttctttcccatttaactctcgggaatcatgtctgacatgtgttaggaaatcacatctttaatatctaaacatacgggaaagaatagaaaagatcttgcctgagatcccttggtgctttaaaaagaggaaaatattctctgcacatccaaggacaatttctgtagaaggtccaatttgcaaacctgaactcgtaagtatgtgtatggctaaaggaattcccttttccctgggcaccctttaagctctggctgcccggagggctccagcagggcggggctgcctggctcgaggtggggcgccttcttctgagggtgaggtcaccggaatcctgtgcttggctgtgcactgtaacatggagtgctgccacccgttgcctcacactgctctcagacgctgggtgtgtgccggggtgtgaggccccagggtcctgctccccgaggtcaacaccctcaggagcagtagaggaggggctgagcttcaggtgggagaggttggggagtggcataagaactgcggtgcccaggctagccctttggatgggcctgagccaggtcccagatgtcagtagcatttgctttgattttggactcagagcctcagtcttccctatgtatacaatgagaatagtactggtgccccatacagttattgggagagctaaattagagaatctatgaaagccattgaacccctggtcaggggacgtgcacagatgcttgccaaaagatgatgatgcagacacgaccccatcctcaaagagctctgtcattcatgtgcttgttcagtcatttgaccaacactcttcagcatctatctcgtgccacacactgaagcagtagcagtggtcagcaggagggtggcaccatcagaaattccttttacgacatgagtccagttcaagtcccagcccagccccacttctgtctccttgagcaggtgcatggtttctccacgctctgcccccctcacctttaaatgagctgacagtcaactcctgctcctcggcaaatgcttaacaaccagttctctggatgggggaacaaaaagccctgctttctagcatttgccagtttccacagtgtaaatgctcccacaacagccaatgtgattttcagctggattgagtcaaggtgagagggaaaaagagaattttaagaatgccaccggccgggcgcggtggctcacgtctgtaaccccagcacgttgggaggccgaggcgggcagatcacgaggtcaggagatcgagaccatcctggctaacacggtgaaacccccgtctctactaaaaaatacaaaaattagctgggcatggtggtgggcgcctgtagtcccagctactcaggaggctgaggcaggagaagggcgtgaacccgggagacggagcttgcagtgagctgagattgaaccactgcactccagcctgggtgacagagcgagactccatctcaaaaaaaaaaaaaaaaagaatgccaccaatgtcattcctcagtttgattgtcacacccccaaccttgtcattgccaataacgcaccacctcccaaattcctcattcagtcaacaggcatttcctacgtacctattatctgccctgttctaggcatgggcaaatacagacaccatgtagaagtgggtgggcagataggtgatgatcatacagcgtaataactcttggaaaatctagaaatgcacaaggtgcttaccaatgggtgtcattaatccttgtttggtaggaaggtgtagtctgatattctctccaccagatggatggtagctgaggagggtttcagagggtttcaaaccaaggacacccttttaatttcttacccaacaaataaaagaaaaaagaaaccattgggaagggtgggcaataacagcaaagatagcaatagatcattgcggaaatggaagagcagattttctgagaaaaaggctaccagcagagtaagaggacaggagagccagggctccagaggccacccagggaggaccgcagtgacctggggaggaacagcttctattcgctgctcccccaacagccctcctccccattctatccaggctccagagaccttgtaggataaactgagggcagggaggtacaccaactccacctgtcttttttattttttgggtcatgttaaaggttttgattttgaaaatcaaacctgggattctggtacattctatagaaatagtaaaaaaaaaaaaaaaaaaaaaaacaaaagtccctccatcctcctttttaaaaacaatttcaaatagcagccttacagtgactctggcatcctggtaagtaaagagccaagattttatacagaagtgaataaaaatagaaactcctccaccgtgtgttctgtgttcctgaaccctaaggtgaggtgagcttcagactccactatgcccagtacaagttatcctgcttggactaaggtagggcaatgacatatgctaactgaacagttactgtgtgttgagctccagggacattaggaagagtaagagacaggccttgttcttgcagaagagacgattataatacagatacagtgtggtatgtgcgcctgcatgatgcgccagcatgatgaagtgtgttttaagttacacaagggaggtcgatattaacactgcagggtggggtgtgtcagggaagaattctcagaagaggggacacctgagcaggatttcaaacatgaatggaaacttgccaggtgtacaagatagggaagggtattccaggtaacagggaacagaatgtactaaggcggaaaggtgtgtttgagaactacaagtggcttactcttcctgcagaataaacaggacagggccagtcacggtggctcacgcctataatcccagcactccgggaggccgaggcaggcagatcacttgaggtcaggagttcgagatcaacctggccaacaagatgaaaccgtctctactaaaaatacaaaaattagctgggcgtggtggcctgtgcctgcaatcccagacccccaggaggctggggcatgaaaatcacttaaacctcggaggtggaggttgcagtgagctgagattgcgccattccactccagcctaggcaacacaatgagactctgtctctaaaaaacaaaaacaaaacaaaacaaaaacaaacaataaaagcacaggaagcagagctggaggcagaactagagggagggcagggcaggcatgcttatgactttgagggcaacgattcccccaccacaggattatattaataaaacgagatgcatggggagggggcaggcaggagcaaagtgaaactggtcagatttgtgtttcagaaagatgacccttgggtagtcccatggaaggtaaccagaaggtgaactcaagatgggaggtttcagaccagtgaagctgctggaaaattctaggcaagataagcagtggagtggcagtggggctgaagagaactgagtttgatatcaattaattataattctcctttcccttgtggttctcaaatctacagatgaggctgggcacggtggctcacacctgtaatctcagcactttgggaagccgaagtgggaggatcgcttcagcccaggagttcaagacaagcctaggcaacacagtgaaaccccacctcatttaaaaacaaacaaactgctgattgtcccccaccatcccagaggagagcatcacctttagttcagacctatccggagccaggccttacatccttgcctagccaggctggtctcctcaggcacccccaacaggagagagtatctttaaatgcctggccatgagttctcccagcaaagacggctttgagaccctctatttctcctgaagatgaaaggtctctctccaggtcactggccaggttttggatcgtcctcaagggacccaggctgactcagagtctacaagctggacacatcaggcagggaagagtggtatcctgcaattaccccacctgtccacaacaaaacctgattctactggaaggccctggaccaggaatgggaagacagagaaacgtctgtcttcctgagaagggctgagaagggtagaaaagggggcagcatcatcgtccccgttggggttggggtgggttcactgtctgtccagactgcagctcctctccccttcattatcatctgaaaggggaaagaagggggccctgtgagctggcttcttccctttaaccacttcctcccctgggagacagctcacacagtgcaggaggggctggggagggggctggcccagaggcaccagactctgcagaaccacccaggcattgtggggctgccctgccacctgctggccgctcctggtggcaggggacaggcatttttccgggattcttcaggacaggaccgagactctaaggcagtcagcatcaatttggagaaagccgggaaagtgttgcgattcagagaggttaggaagttcgtgaagaatctaggatggagttctgtgggagaagctgtatgttggtggtaggaagtctctgtcacaaacatctaataattgcagggccaactgccagatgagttaatgagtcttagtttcttacttctcccctttttcacccactgaggggcaagaacaccataaacaaagactgttgagtcccaattaaagtgtggccataggacgaatgattgaaatatattgggaaaaactcctctggccaaagctgtgtccctacccttgcacacagcctaaaattcacacactggtccttcctgtggaatagagagactgaacatcaaattcaaaatttaaatgttatgtctgaggccactcattgcatttcaacctcattcactgttcccctaccctactgtataccacatggacactggagggacagatattaataagacccaactttatcacccaggacctacagggaagagtgaccaacggaccaatgggttaaataaatagcacaatgggataaatcctaatccagactgccctgtatatttggcatgaagaaattaaacaggcatgcctacaaggggctactgttaagatgattaatgttacacaggaaggatcacaatagtcagcaataataatatacacttatgcagtacttactgtctaccaggcacatcccatgcactgttatactaactcagatcttaaccctacttacatacattaactctatgacataggtactatcattattcccatttaggtgcagtaatttacaaaggtcattagtcacttcagggtagagatggaatttcaacccagatagcctagctctgatgtctgtattcttaacattgcaccatactgccatttattaagttcaacctccatgcaaagacgtaacttccctgacaaacagctgagccagggataacacagctagcagagaacactcaaaatcaaggtcaaatgttgggatgaagagagagagaaaacttcaagggccatgcaggcattttgactaccaggcagatgggcattgttcagggcagagggcctaaaagaaacaccccggcagacatcaaccactaagctcagagcctaatagtgatgctttacataaacacataagcagagacaaacaaagtttcatgataaatacccttaagcaagcagcaacacctaagatgattcacactggatcggaagacaggtgattcacatgaccaatctggttaagaagaggcaatttctgagcaggaagcagtaaagtcagactgatggtctgaatctgctgaacatactttaatgttgactttacatagagtatgcattaaaaactataaatagcaccaggtgcggtggctcacacctgtaatctcagcattttgggaggccgaggtgggcagatcatgaggtcaggagatcgagaccctcctggctaacatggtgaaaccctgtctacagtaaaaatacaaaaaaattacccgggcgtggtggcgcctgcctgtagtcccagctacttgggaggctgaggcaaaagaatcacttgaacctgggaggtggaggttgcagtaagctgagatcgtgccactgcactacagcctgggcaagagagcaagactccatctcaaaaaaacaaaacaaaacaaaaaaaactataaatagcaaagcatagatttaatcattcccaaactaagttaatgtctcaaggagtgaatgagtgtatatacatgcacattggactaacagagcatctggcacatttaatgaatgggatgcattcatttattcagttaatacatagttacttggtgcctactgatacggtttgactgtgtactcacccaaatcttatcttaaactgtagttcccataatctctatgtgttgtgggagggattcagtgggaagtaattgaaccatgggggcagttacccccatgctgctgctcttgtggtagcgagttctcacaagagctgatggttttataatgtgcttcccccttcacttggcactcattcattctctctcctgccaccctgtgaagaggtggcttctgccatgattgtaagtttcctgaggcctccccagccatgtggaactgtgagtcaattaaacccgttttcctttataaattacccagtctcaggtagttctttatagcagtgtgagaatggactaatatagtaaattggtaccccagagagtgggatgcttctgtaaagatacccaaaaatgtgtaagtgactttggaactggatgacaggcagaagttggaacagtttggagggctcagaagaagacaggaaaatatgggaaagtttggaacttcctagaggcttggagggctcagaagacaagaagacgtgggaaagtttgaaacttcccagagacttgttgaatggttttgaccaaaattctgatggtgatatggataatgaagtccaggttgaggtggtctcagatggagatgaaaaactttttgggaactggagtaaaggtcactcttgctatgcaaagagactggcagcattttgccccggccctagagatctgtggaactttgaacttgagagagatgatttagggtatctggcagaagaaatttctaagcagcaaagcattcaagaggaagcagagcataaaagtttgaaaaatttgcagcctgacaatgtgatagaaaagaaaaatccatttgctggggagaaattcaagcccactgcagaaatttgcataagtaacaaggagccgaatgtttattaccaagacaatggggaaaatgtctctagggcatgtcagagaccttgggggcagcccctccaatcacatgccaggaggcctaggagggaagaatggtttcataggctgggtccagggccctccctcctgtgtgcagtatcaggacttggtgcctgtgtcgcagccacttcagctgtggctaaaagagaccaaggtacagctgaggctgttgcttcagagggtgcaagccccaagccttggcaccttccacatggtgctggccctgcggatgcacagaagtattcaggtttgggaacctctgcctagatttcagaggatgtatggaaacacttgggtgtccaggcagaagtttgctgcaggggtggggccctcatggagaacctctgctagggcagtggggatgggaaatgtggggttggagcccccacacagagtccccactgtggcactgcctagtggagctgtaagaagagggctactgtcttccagaccccagaatggtagatccactgacacttcacactgtgagcctggaaaagacacaacgccagcctgtgaaatcagctgggaggggaagctgtaccctgcaaaactatagggatggagctatccaaggtcatgggagcccacctcttgcatcagcattacctggatgtgagacatggagtcaaaggagattatttcagagctttaggatttaattactacctcattggatcagagttacctggatgtgagacatggagtcaaaggagattatttcagagctttaagatttaattactgcctcactagatttcagatttgcatggggcctgtagcccctttgatttggccaatttctcctatttggaatgcgtgtatttacccaatgccaatacctccattggatctaggaagtaactaacttgcttttgattttacaggcttctaagaggaagggatttgccttgtctcaggtgagactttggacttggacttttgggttaatgctggaataagactttggggaactgttgggaaggcatgattgtgttttgaaatgtgagatttgggaggggccaggggtggaatgatatggtttggctgtgtacccacccaaatttcatcttgaattgtagttcccataatcctcatgtgtcatgggagggacccagagggaggtaatttgaatcctgggggtggttacccccacgttggtgttctcattgtagtgagtgagttctcacaagagctgatggttttataaggggcttcccccttcacctggcactcattcattctctctcctgccaccctatgaagaggtgccttccaccataattgtaagtttcctgaagcctccccagccacgtggaactgtgagttgattaaacctctctcctttataaattacccagtctcgggcagttcttcaggcagtgtgagaacagactgatacacctactatgtggccacctttggagacatgcacatgcgaccctgttctccatccccaaaagccatgtatgagtccactgtcagacttttctggttcccatccatgtattcctctgctctggatgcaatgcttccatctccatagttgggctcacttcctgaactgcaatttctatgtctccagctagactgataacatttatcacctctgagtaccaaacagctgggatagacttattctccaaatgcagctccacataagcaggagcctgttccctactatacccatgcatctcagctatgcctggcaccgaatcagtgctcagtaaactacctggtgaatgactgctacagtgatcttgacacaggtatcaggtctctgccactgtggaacttaccagctagggagcactgtctgagaagaggctggcagtggtcatttctgcccacctttggtgttcagaagacaggctctggagccagactgccagtacctgggagagctgagatgcacactcaggcactctgatcccaaggtttgggataaggactgtggacttgtattgctttcttttatcctcataacaagctcattttatggaaggagggtggctgaggctgacaggttaatctgccaagtactgccagacgtatttcagatattaaaagttttccatttttaggaaggtaatatggtgaatataccatattttatataacacttccagcaggctctgaactatactccatatcaaacacattcagatgcttgcagcaaatcatatgaacaaacacacttagtataattatagcctcactttcctgcagattaggctttgctaccaaaagaattgcaaaacattttctagtttccagagtgtgttggatttgggatttgcaggcgagggactgtggacctgtaaatataaagcccttagaagagaatgtggcactaagtaggtgctgtgggcctagcatgcagcagccacttggtacatgttagtttccttctctccagccaggctctgatagcacccaagcctctcatagctctccccttctatttccccaggagatgagataatccccactcctctcttgccccagaaggtggtagcacttgcaaattcctacttaccagtctgtatgggcatcatcgatcaccaacaggatcctgggtctttgaacaatgggcgtggagggacctggaggctccatcagtcctgaggtggcctgaggggcctgcttcatggcactggagagggagctaaaaaggctggatcctggagaggagaaggaggcagccaggggctgggggtgcctcctctccatggcgggggaagcaggtgagctggtggagctatctgggcgttgcaggtccgtcatatagccattaggcaggttggccatgaagctgctgtcagagagacgtcgccggaggaaattcatggctgtggatggatggagatgactggctcctacccagacgtgtgtaggtgaggcccagaagacaggctgctgccaggtacagggagtggtaggactttagccagaagagccagggggattttgcgcaaccagcagtcagctttagctgcctttatttac

SEQ ID NO: 1040 - DNA, 494267 bp, Homo sapiens; identical to SEQ ID NO: 1039

SEQ ID NO: 1041 - DNA, 279852 bp, Homo sapiens
ttaagtaagttccggggtacatgtgcaggatgtgcaggtttgttacataggtgaacgtgtgccatggtggttttgctgcacctcaacccatcacctaggtattaaaccccgcatgcattagctctttttcctactgctctcccctaaaaattaatttagtttatttaaacaagaaataactgtaaatggaaagtttcccttgatttcatagatattattaaaattaggtattccaagagcccgagactgatgaatcaaagccttccgtagcattgatgagagatgcatcagtgagcaagctagtgtaaaattaacctgagcttcctgctggtgccacagcagggtgcttcagggggaagccagttttcagcacgaatgggctgctgtggaaccctgtttccagttgtcaagacagacttggcatctttttccaacattctagtaacccaaaggaaggaactgagataactactaatggattacttagagcgtaagtcattaaaaacaggacacaaaactgaggtataaaaaggaatatttatcttttaaaaatacaactttgaacactactggcatctcatttacaaagtatttttgtgaaatactctccattggctttgcttgctcagtacattcttttatcttcaattgagactcaagggagggtatgcttgcattattataaataccacaaccaccaccacacacaataaagaccatctctgcctcaggacattcgccccaaacctccatcctctctgtttactttccaccaagcagaagtttctgaatggtccactcacatgctgccattgcgatttgccgatgggcactaccaaggtgtctctggcaattcgcactccaggtggagctgacctatttgtagaaagcctcacaaaccctagctcattatttattcattgattcattactattaatacttatatcaagtctttgcaaacattcagcatgaagtaaacatagtatttacagcagtactcggtttgcaattcaacacactgacaacagaagcaaagggaccaacagactgtaagaaggccagaggggaaagaatattaatataaatcccttctgccactgtgtgcgtgcgtgtgtgtgtttgtgcgtgtgtgcccacacatgagcatattttaattcacagaaaactgaacatgccctcctttaaaagcagactatttacaagtgattctgaatagcatgaacacatgccagtcatactggatacttgctttctgtaaacacatctagatgtactttttacaattctgaaacagatctttaatgtgatatgttagagaaaataactttggaacatttgtcaacttttggttcatagtaattttgcaaaaagccacaaaccatgctttgtcgtttaaaaggtgaacctggtcaggcaccttctagaagacactgatgtgttatttatttactggtctactggggattggaaagacaatggcagttacacagaggacttagtgctgctctcatgcctttcaccagtaacaacattaatgtaaagagaagtttagaaacacaaatcacatacaaatcatcaaaacatttcagttaacagtgtttaaaaaaataccaaggtctacaacagtagtacagacactgaaaacactccaaatactgtttagcatcaggacttttgcaatatttaaagacaaccaattgacagaaaggggaggaagttacagcacttgtggtttgaggcaatttctctttagggcctgtagttcgaggtgctgtcctaggatccttattttaactcaaaagattttccaggaatgaactgacaaattcaaaggaacttccacttgaaaaccattaaaaatataaatcactttctatgcttgtccaacacatatttatcttcaggatcccaagttgttaggcaaagagatttaggtcagcttcaagccctcgaagccacagaatttccatctcttttccaggctggctccaactccagtcatttcctgcttgaaggtatgctggagtctacccatgagacactccacatcgctggtgcagatctgtgggacagagagaacatctccattcaaaaccagttctattttcctaatcttctttcccagtgttgcctactttagaatgctgatgtgtctgtgtgtgtgctgcaggggcgtttaacctcctcctgctccttgcgcatttgtgtgtgttggcagagtggcttccagccagcagcgttcctctgctgtgaccatcagacagggtctgctgagttgctattggaaagagctggggtcagtcatgtggaaacgcctgggtttgtaagaagctgaatgatggctgctcagttctagtgatgctgcgtgcaggtccactgaagctgctgagccttttgggaggggaggaaggtagaaatggctgccaccagagcagaatccctcacaaatgcgttagttcataatggagaagtaacaggaagggggaaatcgctgtgttcatacttctctgcatccccatctctctctctctctctctttcacacacacacacacacacacacacacccctcaatacgaaaacaaaaacaaatctgtggactcctttaggacttgttttaggtggtcatcttcacattagtagagttagtaagttaccctcctcactatgagccttggcaccagggcttgggtaaagagcaccaggggatcctgaaagacacccagagttggtgtcacagtgaatatccctggagctggagggagccccgattctgttggtatcacctcaggctctctttgggagaccctggcactactccggcaggaagttgctaaggcggagctaggcctaggctaggagggcagttatgccttcttcccagtgctggcagtagactgtatccagtcaagtgaatgaagcacattccagggtatcatatagagttgaatccccatttcagaaaacatagataatgtgtatagatatatacatttaatataggtacagcacacttgcaggaaagggtctgaaatatgtgcccaactgttaacagtggttatccttgagcagtgggattgtgcgtggtaacttgcactttactagatttctacactgcttacatttttaagataatgtgcatgtattatttttgtaaattaaaaaataagcagatggtttttactgacacatagttcaatttaataccattgcaatggactacttggtcctagtattcacattccatcctccccttcactgccaaatgggctatttaattgcagaatagcatcacttcccagagggaaatgagggggcagtgctagctagaatgaaagcaaatgccattgaagaggatgtatcaccacagctgggatgtggttagaacaataagattcccaagtgggccactgtctttgttaagagaacatatgcttaaatgacttaacattttggacagcacctatattcaatggcacttctcaaaaggcccagatcctatgaaataggcagtacaatttatgggcacatttcactgaatgctgcttctgaaaaaaaaaatgtatcctgagctgattcattctgaggagtcaagagtcccctcctgcatcttagaggcatccttgatttcctagggaattagcacttacccctgctccagatgccctaggagttcccccaaaggatagcatccagagaaggaaatggaccatgagatcatctgtgagcaaatattcagtctgtgttacagaggctctcagctcattgctccatcttttttttttggcacctgcctcccttgttttgtaatagataatagcaggggtgatggtgggagaggtggatggaataagacttcccattttgaaaatgaacattggataatggctaaaaaccagggacaaaagtttgatggggccgggtacggtggctcatgcctgtaatcccagcactttgggaggccgaggcaggcggcttgcttgagtccaggagttcaaggccagcctgggcaacacggcaaaaccctgtttctataaaaaatacaaaaattagccaggcatggtggcatgcatctgtagtcccagctactcaggaggctgaggtgggaggattacttgagcccaggaggttgaggctacagtgagctgtgatctcacaaatgcactccagcctgggcaacagagtgagaccctgtctcaaaaaaaaaagtttggtgggtaagaaagctgatatgggttggtttgcagcttacaggtaaattaagagaggaaaagtcttctaagatatatgttggaaaaaggatggtcaacttattcaagtttgcctgagactgccctggttttaacatcgaaaatctcaagtcccaggaaacacttcagtctccagcaaaccaggacacatgggtcatcccacttgcaaaggggaagctctgcactgaatcacagtgagagagcaggtgagggaaacttcctgaaagcagtaactaatgacctatttatgcttgaggagagtcaggtcacctgttaacaaaaaatcccacatccccttgcatccccattttaggcccccatataccttattatcaagacggtgcaagtaggaacagatgtattcaatgcttgctccaaatgggtgaacatgaaggaatgtggagataatccctacagagacaagagcatggaggttatacttgagccttgtatttctcgaggttccacatgacagtgaatagcaagagctgactcatatgtacaacagaaatatactggacactattctaagtttacacgtattttactcatttaatctttataataatcccatgaggtgtgtattgtcatccccagttcacagctgaggacacagatgcactaaaagtgtaagcaacttgtccaaggtcacacagctggtaagtggcagggctggtatttgaacccagacagtcacatactgcctcttactgtgctatatcacatgtagaaaagctggcatttgaggagtcactttcattacttgtgatggctaaacactgtctgaattcaaggattttacaatgaatttacactgtgctgggcttttgcagttccttcacagtctttaaattagactttagcctcttaggtgttaataatgccttgctgttgtggtaaaagtaaaaatcatgtactttcctgattaaccttgtgcctctcacaagaaagtctgctgattgtatttgggtattattttgtgaacagctctgtaaagaaaagtcaaacatttcattcacggctaactcaagtggtcactagcattccatgcttagagccttgaatctctttgtgtaacagaattcttatagcagtttacagcctccaggaatgcccctgatttccacttagcctaactctggggtggctggcagcttcacatgctgccttcattgttctggccattaggttaattgtttaatacttctttctctgggaacaggtggaaaataaatttttcaaaagtataatatttctttctttcaatttttttttttttgcgttcacctcctttcataagatcttaagtgcatcaaatagacccagaattgagtttgttgaaaattgtcaggaaataaaagcaaaatttgatttggtttctaaactacaacttgtctgtccctttaagaggctgacaaagactagcacaggtttaaattgtagtttgaagttcaatcaaaggggtaagttggggaagggttccagaaggaactgagggcagggctcaaaatctgttccaaagggatgctattacttagaacattactttattcttaaacgactagataaattgaatttctaaacactgattctggctgagaaacttaaattctgaagaagacattccatgtttgaagaaattctagacgtcttggccaagaaaggctgtcaaatgccaagaaataactccagaggtttaaaaacattaagcgattttgtgggttcacacccaaaaagctgattgaaaaaatagattttcctttctctctgccagcccaagactaccttcttgaaaaaacaaaacaagaaagacttattttaagaatctttttttctaggactatccattcacagaggcttccttgtatccccagcatttctctgacaggtctccctgttgccatgccaatttgttaagaacttggagttggaagacgttaataagttgtaataagttgtcacttttcttgaagattcaatggcaggtccccctgtgcatctttattaacatatcaaagtgttaaatctgaggataatatccattaccaaaggaggcagagatatcttaaaaatatgcagaagccagtcagtgtggagggcttttgagactagagtggggctactgtatagctcagcttcctagatggcagctgggattatctgctgtggcctaagaccagtcactcttaaatgattagcccctcttaaatattttagagcctcaatctgccactgttctccaaatggaatataaagttagccagcatttgtgaatggtgctgtgaagtgtaatatgttttctacttactgagggcttactatgggccaggcactatgctaagtgatttaggtgagttatcgtattaaatactcacaactgccctttcgggtcggtaatatcattatgcccattttgcagatggaggaactgaagctcagagaagaaatggtggggtcaagatgggaagccaggtctgtctgattctttaaccatttgtgccatcttgcctctctgaatgaatttttacagacagcaatgctagcatggacctcatcaaagcccactagtgtccaaaacaccagtttcctgagtcatctgtcactgtgatataataaaaaaattaacatgtggtctttgtccgtggtccccggggcgcacagctcctaaaacctttggaatttctggagtgataagagttaagatgagtggtagctgggggccccttataactttagaattggggctggccatcagaaagacttaggcatgattagagggaggagagagtggctggagattgagctaatcaccaatagccagtgatttcatcagtcatgcctatataatgaagcctccataagaactttgaaatgatggggttcagagaggtttctggttggcaaatacatcaagatgcgcacccaaaaatgtatagaaactctgcataccccttcccagtaccttgctctatacacctcttccattgtatcctttatgctaaatcagtaagagtaagtaaggcactttcctgagttctgtgagccattctagcaaattatcaaacctggggtgggtattgtggaaacccctgactttgtagccaaatcagacagaagtagaggaaacttggatactgtatatttgagactggcatctatacagagggcagtcttccaggactgagcccttaaactcatggagtctaatgttaaactctaactttgggtagtgagtgtgagaacagaattcaactgtaggacacccacttggtattgaagagttggagatgtggtgttggaaaagacaccacgtatctggtgtctggaggttaaaacaaacaaacaaacaaacaaacaaacaaacaatcccttgtcatttggtgtcagaagtgttgtaaaaatagcttagccagtaacctggaaaaacttgagaggcctatagttgctccagaggctctctggaaaagctctctgccaaatacggtctgcgctagccccctgagtggacatgagagggcttatctatccttgcacagatatttaaaaaaaatctacagtgtgtttctccagctgacccctcttagcttagtgcttgtactgacatgcttgactgcttgacatggcagtggctacaaggagtgtgagggaggctggcagctgctgttaaatttggaaatttgtacttgttcttaacctatcatcttcagaactctgagttcttgcgctgccatgcttcataaatgcttggcatgtgcttattaatcttaggtaaagccctcctctcctccattgtacccaggcattgtacgtggcatgtgtgcattagcttccttacccactagcagtgcttcacgttcagatttgataggactgctgttcatggtcttctcaagagggtattcgctatcctggtttgaggcacacagcctagaagcacagctttcctgtggacacaacatgcttctaggtcagttcactttatttggcaatagagttggtttcaattaactacacaacaggtaacttaacacaggaccataaaaacaataccattcaatttggattactgaatgggagagaaaatagcataaattacaaaagcatcacagatattccaaagtttatttatagggctccaaaacacagaaacatttaaacatttaccttcaccagtttttttttttttttttctgccttcatcttgactttatacaagcaatctgggcaactagacccaacatttatggtatactaacaagatgctaggcactgttaggtaagtattatctccattctacagatgaggaaagtgaggctcaggtaaattggctaagatcacactgcaaggaagtggagccaggatttcatcccactgttaaaaggaccattgtttttttaaaaaagtttaaggtccacactctgttaatggtaagtcccatctcaatggacaatctacgttggctacactgccaatccactgatagtgaatcaactgttggtttttgaactaaaaattagagcttatattccactgacagttaatcaactgttggtttttgaaataaaaattagagctttcatttactagtctttctctctctctgatgaggacattatcagttagaatattcctgactttacagcaagaaatgaccatgacaaaaaatagcattagtaatggccttctttgttgtggaaagttcttctctttcagaatgtagcaggaaggggcggggggggggggtggtcctaagagaaactcaggtgaaatccatgaccagcagtcaaactgaaaaatacctccagacctttcatggctctttctttctctctttgggtacggagaatatcttttctgttattataaatgtgaaggcaaagctttcagaagaaggaataaaagaaatcactgcttcttttactgctgaaaagaaaatgctgctgaaatgctccttggggggcagatcatggctgactcagatgcattttcacttcttctctttccacaaacccttagaagggacaggattccttctgttttcttcaaagatgtcttcaaagcttccaggatgctgtctctgaatgaaatgaatggtctatgctgcaagacatgttgttgtgtgaatttacaggcttcctggctgtagtcagaggggaaccctttcttgatgacctactcaatctttggcctttagaatccaatccaggcagtaaccattatgccaagtttgatttaaactactagctcacttctaagccatgggcttcacatctgcttctgacccccttaaaacattaaatgatacggtaagccgtttcttaagtgtgagagtttaacagattggggttgatttaagatgtgaaaatattctgggaagttttagccatcttgaatagaactgcagccttccttaaacctgacttcaattttattatagctggcatttaaaaaattagaaggtacattgaaaggatgcttatcaccttgaattttactagcagatttaaagagcttagttctttccgcactaagacagacataagtcacactgttatactgcaaaacactgacaataactcaccctgtagcttactgtcaagaaacccaaacaaaagcaaataaaaaaagagatccctcctcaccaaaacttattgctttcctttcaacctgaaattatttttgcagtctaatgtgatggtactttgcttcctaacctaattgtgtcaggttgaaatatttggtcacaaatcagcttcccagagaagatcagtttataatgaactgtcatgaatttctctaaaagaagctttgcttaaaataacaagaaaaaaacatattttgactcactgttttttggattatcagttggatcttttcccctgtcctcatcagccaacacttcatggtctattcagtttccaaatgggaaacacttgcccttaggcacaatatggcaagtttcttctatgccatttgacctcttacttctttaaatgaaatactttacaaagcagaaagctacttacacaaaaaaatgtccttaggtcaaattgtgatgtcaatcctgaagagtaattctaagcataatgtcatgagcataaccccatgtctgtctacagtcttctggatacataatccattttatgcaggaagcaaaacagagctatgtggcagctctgggacactttagaagccccgatggcatgaggaaagtcctgataagtaaagcagctttggctcttttcaattaaatgcttgataaatgaatttctctgggattatgcttgtttctttaatagtgcccacaaaactggaaagtgagttggttttatgaagtggaagaattaaaagcacgttgcaaatggcctctagaagaaaacactttcaatcatttgtttcaactacaccaaggttgccagttcttaatgacactctaggggaaggcactgtgctggtaaacacactcagggcctgtatgcactgcatcttcctgagctgagaacagaagataaagagaatatgctcttgaggaactgtatcactgttgatttctgaccctcggtccaagctcctaatcttctcttcctttagagaattaaaacaaggaagttttggtgaatgggcttcccttttcagaggataacatcagctgagtattgatgcatcaaggaaattggagaggttgactttacacaccttgaatagaatgggcacctgattcatggttgtgatacatgattctatccagatattagactctctggtcctcattggtggttcttattgctgagagctctcaattgataaagtcccatcttggcttctagctttagaatactgtgtctcattttttttccccaaggtttctctcttcttggtattggctattcctctcatctgcagctgctcattattacactaaattgactagctgcaaagaaatgccaatgtgctagctgcacttgtgtttcttcctttaatgaaatgctcaattaaaggtgctttgtgtcacatgagttttctatgttgctatttgcttgacaagatgaagcagggaagaggtgtgcactctggtcgtctccaagagagaagactgaggagttttagggatgaaccgacttcttattcattgaaaggtgtacactccagaacccttagaaatgccaaggactcacacctaaaagcaaagcccttagtataagaattacccccgagaggggcttttaattcccaatcggccaaaaatgtttggccccattgatttctagggcataacttccagggcattttcactgtcactgaaaagtaggtaaaggggcaaggaaaaaggttcacttagggtgcatgtaccttttctttaagattttccaacattttttccacctgtaacttgtcatctttgagtttttcaagttcagcttctttctttttgtattcctcttggactttgagtagatgctacaagaaaagaccaaagacaatcaatttatgaattacggagccacacttcatttaaaatctctggctgaaatcagatatcaggtgggcctgcctcactttcctccagcacacacgaccatttttccataaagagattgggcaaatcaagatattttcactttacgttattttgtctgcctcttacgaaattcctttgaacttgttaatattttagaaaggtcctgagaaactaattgatccagtcacttaacttcttccctattctggccaggggtcagagtaggatgcagttaatactgtgtgggcaatgttttgattgctgcatataagtaaatgtaatgttgtaaagcattcttgcaaatagccatttgccaagccaagttcaatttctgtgaggatagtagtaaataatccaaattttacatgttagtttccatataagtaggcaggaagctatatttagcattattaataatttcaacaaataatatttattgagtgcctaatatgtactaagcattgtgctaaaggtgttacatgcacggtctcatttaaacctcacaatgaccctatgttactattatccctaaggctaggagaggttaagtggcttccctaacgccattcagatagtcagtggcagagctgggatttaaaaccaggttgggtcaaccccagagttcatgtccttacatgccttattatactatacgtcttttgagataagatgtgagaaattttatcattgtttacaaggcatttttttcaatacaaaataatcaaaatgagtgaaattattttttaagacgtagagacctaattctcactgaggtctttgaagtgatgaaatgaaataaaatttcatgattttcgaattgcatttaagtagcagaactatccttatgtgaaatggtttgaaaatcaaagaggggaaaaacagcaacaacaaaaatgtttccaaagtcttgcttttcagaggcttgcaaaagaccactggaagggttaaaaagcatgatacaatgtacattgtcaaagttctttgaagtgtaggtgaggaggtgcattttttcatagaaagatctctgatataatttacatgttctaattaaactccatggtgacggtaaaaggaaggtgagcattacttcacacattttgttaacagaaaaggtgaaatattaatgtcatattacttgtcgtataggaagacaatagtggcagaaagaataacatagggttcctagtgccagaatagactgctgttcatgatttgtaatttccaaccagcaattagctttgccctagacaatttcaaggcatacagttaaaaactattgcacaatttaagatgtaaggacaatggctggtagtctagcatgacagaagacaatagtggccttactcagaggcactactcctttactatagtgaaagcagctgttgatatcttttaaactgtaggatcactgtggtgatggttacgtaaaactcctagatgttgaacatctgctacactatgttgtctgtgaatgcaatcgcagttgggtgcatttatttactttgctttttacactttgaattatgcacaggtaaactcattcacataagtgactgttaatacaaaacaaaataaaaacaagttggtattatgtgctcaaagcattgacacttaaaaacctataatgtacctatttctactgaaatcaagggtcgattcctgccattccttttaaaaggctgtatttcttggtattctatcaactagatacttgttcatcagctctttttcatatctaaataattgaggttctttgtaaagaccctgaggccctgtctagatccctaagtaccttctgaagcataaagaaaagattagattatgttcagtgtagtctaatgttaaatatttttcactgaatgctcattctttgaaagttggcaatccattgctatctctgtattaattggaatatttaattaaacacaacaataactccttcctcagccatgccagataatattacatcaagaagaataataggtttgatattcaatttgattgcaggggacccttttataggtgagaagctgatgctattctacccagaagctcagaaaaccaaaatgcctttacctgttgcattccttgcagggcttgttgcaggagtttcagctgctgttctttgttagggtcatcttctctgtggactttgccttgttcttgcttgagcagttctacttcattccggtaggcatcgagctgccaacggaggctgtcattttcttccttcagagcttctgcctgtgatactaaggctaacaatcaatataaaatatgaaaccatatatccagattcatttgtgattcatctggatatcacaaaaaggttggttcttcctcttgatgaagaacttcaggtttgagttggccatctcagcaagagatagatacaaaagcacacaggcctgtttttataaatgaactaggattccaacacacaaaagtttacatcatgttcctcattctccacctcaaatataactaagatatttcgaggtagcatcaattttttttatttgaaatgtaggaaataacagccctataataataatataggaccaattcccttgaactgacaactgcctacacaatcatgttgctgacagatgtttttaaggaatgcagcattgagaaacttaacctcggaatttcctgctgctctgtagctttgtataaagagtcagattctaacttcagttacactcattttatttttactgaaaatgtaagggggaataatgaagaatcaaaagtagtgccagaggttagcaggctggaaagcaaatgctgagggacatggttatgggaggcacacaaatatgggggcccggaaaaagaaatacaaggcacagatggagttgtgttagtgaatatgcaatcgcatttcaagatttctttctttccttccttccttttttttttttcttttttttgacagagtttcactctgtcgcctaggctggagtgcagtggtaggatcttggctcactgcaacctccgcctcctgggttcaagcaattctcccgcctcagcctcctgagtagccgggactacaggcggccacaccatgcccggctaatttttgtattttcagtagaggcggggttttgccatattggccaggctggtctcgaactcctgaccttgtgatccgcctgcctcagcctcccaaaatgctgagattacaggcgtgagccaccacgcctggcccaagatttcttaatatgcacgttttcatgtacttcttttaaaataactgttaaacaacaatttgaaacacacacacacacacacacacacacacacacacacacacgaatatagcattgactcgtctcacagaggaaaagtaaatgtaaaaactaagacataagatttccagtttccagtctggcatgtaaggacctttagaagctgccactctgtcttaataacaagtaaaaagctgaacaatgtgaaaaatcaacaactctttttatatttgttagagaagtgaggttacagggcaaacagctgcccccaaaacaaaactggagatacagacaggtgaatacagagaatcacaatttactggaccaaagacccatgagcagaaacttccatgggacccagtccttgggtaggaaaacctgaggtgtaattaacaaattgctggaggctcagtgtggacaagtctgtgaaattagctgggcgtggtgttgtgtgcctgtaatcccagctactcaggaggctgaggcaggagaatcgcttgaacctgggaggtggaggttgcagtgagctgagatcacgccactacactccagcctgagtgacagagtgagactcagtcttggaaaaaacaaacaaacaaacaaacaaaactccaggaagacccagtcattggagagctcccacacatttgtaagttttagctccaggagatataccagttccttacagtgaatatcagagaaaaatctcctcatgtttctggcaggggaaggggaaaaggaacaattttgaaattgcagaccatcctggtcttcttcacaaggcctgccctcgggaaaatctattttaccagagcctcacctgctggggttttagaagaacctaacagacctgggggaagataaatgtccaactccagccccctcagccatcctgtcccaccaaaggtgtgtgtgtgtgtgggtggggggtgatggtggtgggagtgggataaaactgagaagcactggtgaagttcacagttcagagacacaggttcaccaaaagactgagacctaatcatagaactagagaatgctttcccttcctctacaccttaccacaatattactaaagggctacttatgagaatttctttcacctagtacatcatgtccagattttaatgaaaaattacaaggcatactaaacagtagaaaacacagttttaagagatacagcaaacaccagaaccagactcagatatggaagagatgttggaattatcagactgggatttttttttaaaaaactatgattaatatgcaatggtctttaaagaaaaaattagacaacatacaagaacagatggataataagagcataaagaagaaattcaaagaaagaataaaattaaatattagagatcaaaaacactaatagaaatgaagaatgcctttgatggggaaattattagactggacataactaaggaaataatccctgagcttgaggatatgacaatagaaacttccaaaactgaaaacctgtcttagtccgttttaactgctataaccaaataccacaaactgggtagcttatgaacaacagtaatttatttctcacaattctggaagctcagaggtccaagatcaaggtgccagtatcttcagtgtctagtgagggcctatttcctagttcatagatggtaacttctacctgtgtcctcacattaggaagggacaagcggctctttggggtctctttttataagtgtactaatcccattcatgaaggctctgcccttatgacctaatcacccccaagggcctcaccccctaatagcacattgctgattaagtttcaacatgaattttggaggatacatacattcagaccatagcaaaaacaaaaagaaaaaaacaacagatgctggcgaggttgtggagaaaaaggaacgcttttacactgttggtgggagtgtaaattacttcaacaactgtggaagacagtgtggtgaatcctcaaagacctagatccagcaatcccattactgggtatatacccaaaggaatataaatcattgtattataaagacacatgcatgagtatgttcactgcagcactattcacaatagcaaagacatggaatcaacccaaatgcccctcaatgatagactggataaagaaaatgtggtacatatacaccacagaatactatgcagctatttaaaggaatgaggacatgtcctttgcagggacatggatggagctggaagtcattatccttagcaaactaacacaggaacagaaaaccaaatactacatgttctcacttataagtgggagctgaatgatgagaacacatggacacatgggagggaacaacacacgctggggcttgttggagggtagggactgggaggagggagagcatcaggaaaaacagctaatgcacactgggcttactacctaggtgatggggtgatctgtgcagcaaaccacaatggcacgcatttagctatgtgacaaacctgcagatcctgcacatatacccctgaactttaaataaaagttgaaaataaaaaaaatactgaaaaaagtacataacagaatatccaagaactgtaggaccactacaaaagttggaaacatgtgtaatgggaatacctggaaggagaagaaagaaagaaacagaagcaatatttgaagcaataatgactgagaatttctccgaaattaatgtcagacaccaaaccatagatccaggaagttcagagaacacgagacaggataaatgccaaaaaccccttcagcctacgcatatcatattcaaacttaagaaaatcaaagaaaaaatcttgaaagaaaccacaagggaaacaaacaccttacctatagaggagcacaaataaacattatatccgacttcttttcagaaattgtgcaaataaaaagtggaataaaatatttacggagttaagagaaaaaaaatcaacaacctagaattctgcaccctgtgaaatctggatctacataaagaaaggaagagcatcaaagaatgaaaaagtgaatgtaaaataaaaacttttggctgggcgcagtggctcatgcctgtaatcccagcactttgggaggctgaggtgggcagatcatgaggtcaggagttcgagaccagcctggccaacatggtgaaaccccgtctctactaaaaatacaaaaattagctgggcgttgtggcaggtgcctgtaatcccagctactcaggaggctgaggcaggataatcgtttgaatctgggaggtggaggttgcagtgagctgagattgtgccattgcactccatcctgggcaacaagagtgaaactccatctccaaaaaaaaaaaaaaaaaaaaaaagagagaattatgctaaatctactcttcctgtgctttagaaacggaacaacaaagtctgggtgacagcacatctgtttacagtatggtttaccaaatatcttaggcccactgttgagacctactactcagaaaagaatattcctttcaaaatattactgctgttgacaatgcacctagtcacccaagaatattgatggagaagtacaaggagacaaatgttgtcttcacacctattaacacaacatccataccgtagcctgtggatcaagaagtcattctgactttcaagtcttattattttaaaaaatcatttcataaggctatagttgccatagatagtggttcctctgatggatctgtgtaaagtagattggaaaccttctggaaaggattcatgatgccattaagaatgttcatgattctggggaggaggtcaaagtatcaacattaacaggagtttgggagttgacttcaattctcactgatgaatttcaggagttcaagacttcagtggaggaagtaatggcagatgtggagggaatagcaagacatctagaattagaagtggagcctaaagatatggattgaattgctggagcctcctgataaaagtttaatgaacaaggagttgcttcctatggatgagcaaagaaaatggtttcttgagatggaatctattcctgatgaagatgctgtgaacattgttgaaatgacaaaaaaggatttagaatatttcataaattcagttgataaagcagttatggggtttgagaggactgacttcgattttgaaaaaagttctactgtgggtaaaatgctatcaaacagcattacatactacagataaatctttaatgaaaagaagagtcaattgatatagtatacattattgtcttacttgaagaaattgccacagtcacatcaaccttcagcaacctccaacctgatcagtcagaagccatccacataaaggcaaaattctcccccagcaaaaaagattacaacttgctgaaggctcagatgatagttaacacattttttttagcaatacagtcttttaaaattaaggtatgtaaattgttttttaggcatttgcttaaaagactacagtataatgtagacttaacttttatatgaactgggaaaccaaataattcatatagagtgctttattgcaatattagctttattgcagcggtctgaaatggaacctgtaatatctgtgaggtgaggtgaggtattcctgtatgcatttatgtatgcttatggacaagttaaataaatgacagcaatgatacaagaaatggaaggggagaatcaggagcattttgctattataagatacttgcagtacccatgaaatggtatagtgttatttgaaagtggggttgaattaattgtaaatgtatataatctagggaaaccattaaaaaatgtgaaaaaaagtataaatgatatgataaaggagaaaaatgtggaataatataatatgttcaattaaaaatacaaaaggcagaacaatggagaagacaaaagaaacaaaaaacaagggtaaccaaaagaaaacagcaacaaacatggtagatatttatccaactatatcaataatcagttaaaaaattattgatctaagtatgccaattaaaagacagatgtcagtgtggattaaaaaataagacccaaccataggttgcctacaagaaatctgctttaaatataagggtgcatatagataaaaaggaaaaagatggagaaagatataccattttaacactaattaaaagaaagtggaagtggctatattaatttcagacagagctgatttcagagcaatgaaatttatcagggagtaagaggagcattgcatactattgaaggggttaatactccaagaagacataccaatactgtttgtgagcctaataacagagcattagaatacacaagtgaataactgatacgactgcaaggagaaatacatgaatctactattacagttggagagtttagctcccttctatcagaaatggacagatccagcaaacagaaatcagtaatgacacagttgaactcaacaccaccatcaaaccactgtatataattaccatgtatagactatttcatctaataaaagcagattacacattcttctcaagctcacatggaagtttaaccaagagagaccacattatgggccataaagcacaccttaaaaagtaaaagaagagaaattttacaatgtatgttctcagatcacagtggaactaaattagaaatcagtaacagaaagatagctggaaattccccaaatacatggaacttgaatagtatacttataagtaacacatagattaaaaaagaaatctcaagaaaaatttacaagtattttaaaataaatgaaaatgaaaatacaaattattaaaatttgtgaaatgcagtgaaagcagtacttacgtgggcaatttatagcatttaatccatctattagacataaagaaagttctaacactaataatctaagcttttaccttaggaaactaaaacaagaagaacaaattaaacaaatccaaagtaagcagacattttgtcagtttcttacaaaactaaacatactcttaccataccatccagcaatcatgctccttagcatttatccaaatgaactaaaaacttgtgtccacacaaaaatctgcacatggatgtttacagcagctttattcataattgctaaaagttggaagcaatcaagatgtccttcagtaagtgaatggataaataaactatggtacatccagacaatggaatattattcagtgctaaaaagaaatgagccatcaagccatgaaaagacatgaaagaaaattaaatgcatattactaagtgaaaaaagccaatctgaaaaggctacatactataggattacaactatataatattctggaaaagacaaaactttttactggagatagtaaaaagattagtcattgccagtgattagtgaggaggaagggatgaaaaggtggaccacagaggattttagggcagtgaaactattctgtatgatattacagtgatggatacataccattttaaatttttcaaaacccaaagaacatgcaagaccaagaatgaaccctaatgtaaactataaactttaggtaatgatgatatgttaatgtaggttcatcaatagtaacaaattataatcaattgtaacaaaatgtaccattttggtgaaggatgttgatagtgggggatactgtgcttttatagggacagagattatacggaaactctcaactttccgtacaattttgctgtgaatgtaaactgctctaaaaaagaaacttattaatttaaaaaatgaaggaaacttaggttatatgtaattatttatggtttaggtcacatttttcaagttcaaaaatcataaagcctatttcaaaatatttaatcagaagatttcattcactcaacaaacattcatttagtacctttagaatgaaaggtagaatgaagtggaaagcaaaaaattgtgtaagggtagacataaattagataaaaaggcaaggcttttattttgagccgtctcctcaaccttatttttaatgagaaccaaataattatggtgggttttccataggtattaaagaggtcaataacactagtttcaatgtagtccaggaaatacaatttagaaaatcaagtttcaggcttatgactatggtttaaaaaatatgatcccactagtttctattgtttacatgccaaattaatggaaacatttgtagtttataccttttttgattactaacagaacacaaaacccagaaaaagagacatttttaaaatggatcaaagcagactgggccgcaggccatggggcccgcgcccgcctggagggatggggctgcccagcacctaagggctgggcctgctgcgtttcatgccccagcagccgcgccccacatccacgctgggatggtgaacctagcagccatggtgtggcgccggcttctgcggaagaggtgggttctcgtcctggtctttgggctgtcgcttgtctacttcctcagcaccacctccaggcaggaggagagggcagtgagagagaggaatcccctgcaggttcaagaccatgatcagcccatcccgtggaaagtgtagtttaacttgggcaatagcagtcgtcccagcaatcagtgccacaactccattcaagggaaacacctcatcacggatgaactcagctacgtttgtgagaggaaggatttgctggtgaatggctgctgtaacgtcaacgtccctagcacaaagcagtactgctgcgatggctgctggccaaatggctgctgagtactgtgtctcctgctgcctgcagcccagcaagcaacttctcctggagcacttcctcaatcaagcagctgtggcattccagaacctctccatggcagtcaaagatcacttggaattgtgcctggtcaaatgcaggacctcatcccagagactgcagcatgagaacacctactgggaccccatagcaaagtactcctactgagaaagcctgccagagctcttccctgcatgacaggccagtggacttactccagcctgggtgaggaggccccactgaagaactcccctcctggggcccagcttcagcactcaggccaggccgtgggaagaagacaaaggcagcgttaggaaaccttggctttgaccacttcttgtgttgtcatctttggcttcattcacgacctgggcttaccagatagaactcttctgtaaagcagcttggaccctccagctggtcccatttgggaaagatgaaaccgcaggccaggctcatggcagtgttggcgttcttgcatgactccaccctgagacctgcacagggacctgtgacttgtgttcgttggggactggtgtcacttctaggtttgatccagggcttttcactgtaaaattatttattggattcctttggagtagtgggaaaattataatgttttatgtaggaaaatgccttgcccttctagttgaatatgttcaaggaaattatttttgttgttgttctgtgttttcaagtttcacgagttaagtcatcccttcacccagataaaatgttttgtcttttaggacatggatgttctctctaggcagttatttttgtttgtatttcgacagtatcaagcgtaggccctgaacataacctgttagccatatcctgatgtctaaaattatctaaaaactcagacactcttccattctaatctaactgcaagatttctagcagtgggcactgtgtgtcctccctcagtttcttttctagtgacagttgaatgtgctcatataccctatggagagcactgttttagtagaaatctaacttctcatcctggagaaattttcttttgccacttaaaattaactgtgggctgctaagccagggtacaatgggagcctcaggaagatcagaggcaacttcttctgttctgtcaatagaaacccaatgttgaggcaattcctaaacagagatgtacctaacagcttgctgtatgtgttcattctttattgctttcagctttgggggcgcaataggtataaatgtttagtttccctattatttgcaaggaagaagaagaaacccaacttattagagtgctgcaagagaagagtcttactcctaccctgagtgggagatgagaatggtcattatggcttagagaatgctgcatgtgtaggttgctggtgtgccctgaatccacgtgcataaagcactccccatttttctactgtaatgcagattctctgattcaaggtctagcatatttgatcctaagatcaagacatcattccctttgaatagtactgctctttgatttcagtagtcacattaacacaactctcctatattccttcactaacctcaggattgagcaaggtcttttttatttatttttttttgttgaaattattgacctgggagcagggtgctagttctatggtcagaattcaatattttttttttcagtggagctttttctttgggcatatttgtcttccaatacatttctgcaatatttccttaacttcctactactacctcttatactcatctcccaaaataatttgcctcccttaaataagttttcttagatggtaagttgtcaggcaattttaaaaatattagatctcaagaaatctattccatttgcattaaacatttcagattctgtgtgtttgcagcaggactaaatcaaactctgacgtgaaaaaataaaaataaaaaaatggatcaaatttacaatctgtatattaaatgtataagaaagttaaaaggcaatttgacaaagatatgaattttcttgattacctatagggaagaactttgggtaggagaaagtaaaagaaaagtgatagaaattaaactggctgggtgcagtggctcacacctgtaatcccagcactttgggaggcctgaggttgggagtttgagaccagcctgaccaacatagagaaacctgtctctactaaaaatacaaaattagccgggtatggtggtgcatgcctgtaatcccagctactcgggaggctgaggcaggagaatcccttgaacccaggaggcagaggttgtggtgagctgagatggcaccattgcactccagcctgggcaacaagagcgaaactccgtctccaaaaaaaaaaagaaggaattaaacaattaaaattattagctataaatggtgaaagaaggttttatctaaaggaatttcaaagagaagactcatcctctacataatgaatggaaagaacttgtgcattaccaagatgaaatattgctgtggtttggttatgatttatttttcttcagcaaaatgcatattgaaattttatccctaatgtggtggtgttgggcctagtgggaggtgtttgggtcataagggtggatccctcatgaatagattaatgccctccctgggaaggggggtgcattctcactctattagttgttaaaaagagcctggccgggcttggtggctcatgcttgtgatcccagcactttgggaggccgaggctggtgggtcacgaggtcaggagattgagaccattctggccaacatgaaaccccgtctctactaaaaatacaaaaattagctgggtgtggtggcatgtgcctgtaatcccagctactcgggaggctgaggcaggagaatcacttgaaccagggagtcagaggttgcagtgagccaagatcgcgccacagcacaccagcctggtgacagtgggagactccatatcaaaaaaaaaaaaaaaaaaaaaaaaaaaaaaaaaagcctgacacctcccctctcctcttgcttcctctctcaccatatgatctctgcctacactggctccccttcaccttctgccatgagtggaagcagcttgaggctcttaccagatgcaaatactcaatcttgaattttccagccttcggaattgtaagtcaaataaaccttttttctttataaattacttagtcttaggtattcctttatagcaacataaaatggactaagacaagtatatacaaaaaaaaaaaaaatccacattagcgtgaaaacattctgtactcctaaaaggaagctgcctttagagaggtgctgggtttaattcaactccttgaacatgggggttttcctaaaactagtatgtactgatgtaggctgctgtggtcagatggtctatccaaagcagaaagtggcaacgtaatatgaagggttctggttagaagtatcttctactagtgttgttgaggtgttcttagcatccacatttgttttctgcggatggccatgcaatgatcctgatacagcagttttaaaacttgcattttagttttaaagacttataaaaagatctttggcatgacatattcattttatgattggttttattattaattttaattcttgttgttatgcagattttgtgtctcttggattccaagcactccaaataatatctatccttgccatctcttccagtggctgggatacttttcatcagacaagcactaacaaccacaacatcaaaagaagatactatgagtgaagatgatttttatatacaaaactctatagaaaaaggcatattaactatctgccaaacagaggaagaaatatttggtttgcttgcagggtgagtaccaaggacagcatcttgagctggagtttggctgaatagtacacaggttactctgtaaatcaagtgactcctacagattaacaattattaatttctgttttggtttgcatgtttgtcctctggcagtccacatggctcaatacaaaatagtgatatttcattttcctccttttatttcttcttgtactgcaggccagtaattatgctcatgttctacatgtcacacggagatacatggaagagaaaagggcagagatctaggagaatgattagaggcgtattctccagtttaaatgtaaaaatattttccctctgagaaaatgaggaggagagactgtttttgtcctgggggaaagggcatgctgatgagcagtgatggatacctgcagcaaagtgggagcagataataatcttctcagtttggacctgtcaccaagtgaaagaatgtgatcacctgtaatgctactgaggggaccttacctacaaaatatatttcccactctctgaaatgaggggtttttgtcattttaatgaggacaccaagtctttcctttcacagacttaatattaattgggcccatttctgaagctgaagttctttgtacattgccagaacattgaaaagttcaatattaccttttaataatatgtttgagtaggtgaatccatcagtcctgatactaaagagcatagtacagtgaatgtattcatatcctgccatcattagttcttggcttctcctttttggctatttcctatgtggggaaaatgtttctctttatgacaattgttcctcagatctgaaggctgccagttcatcatggcaatatgaaagtatgaaggcagctgtgaactcctctttttagcggagccactaacagcaaaatcccagacatgtttctgtacaacaaaagatcaaaaatgattttgtgccattaaaaaattagtgcctgagtctcttcaatggtacaaagaaaacaagaaaaaaaaattagtagaagtaaattcagggagtcagccacccttttaaagcttaattacaggagatgctaaaaatgttacaaaattatggaaggaagaatgggtaacatttctctcaaggctaataagaaagtttgagctgaggtgattcacaaagggaaaaagctaaaaagaacaaagagtgggaagaaagagcaggaaatgatatgaataagacctattggggtggctgcaggtcagctcaggcaaaaaatctcaagtgggtttcctgacctcacaatgccttgctttcccttgcctctacaggttattgtcaccattccaaccaggcttctgtcagcatggatgcacctggaacctcattgttacccctcttacatctctaaattcccatctcaaacacagaatcctcatctaccattttcctcactgcctctcatcaccccaagactgctctctttccttgctgggatctttaatctcacggagtggccaagttcactaagctagttcattagctgctttctggctgaatagatcccagtgcaacctcctcagtgccttgtattgcttcagcttcctgaaaacctctggccaggcttaccatgccaatccccaactcacagtcacttgactccactctctcttatcctgggccacagagaactcttataggaagttgcagagctaggcagctacatcaatacacactcatgttggcccttgctgatgggtctctcacctctcactgatttcttccttccatactgcccatagcatttattccaaatcggttcccttctcctcgtggtctcatttccaaatcatttttgtgatgaataaacaatctcttagtatatggagaagcctgggctacctatattctttcagcttcccctctcttgtctcagagaaagagggctctctcctctctaaagtaaacgctacttgaatatggatcccttccctttcttctttcaaagattccacttccatagtattcttttattttctagcatcttcaatctcatactctccattgcctccttcctttttattgaacaacaacaacaacaacaaaaacccttaactttatcgattctagttgccatttataatatccatatttccttttgcttagtacccaacttcttgatctatggtctttgtttactttattttactaatgtcatgtattctggcccctacctctatcactctactaaaatagctcttgcccagcattgtttctctcaattccgattttctttgtaacatctgttaatgtcaatgactacttacttctataaaaacttttcttggtttccacaacccaattcgtttctagttttcttccagcctctcagaactgcttttttctaactcctctgcaaactcctctttctttccttctcccttattgtggatagtcccccaaattctgtatccaaccttttgctcttctttcacttgtctttcatattcatttaataattttctcagggcttcagccgatacctctacactaccatctactattccttctagtttcttcaactctaatttgaatacaaaccccttctgcccatttctcaatgatctactatctgcagttcatctcatcatattccgcaaatcagtcccatccatcagtccatttctgtcagttctactgttatggtttgaattgtgtcctctcaaaaaagatatgttgaagctctcagaatctggcttatttggaaacaggttctttacgaggtagtcaaattacaatgaggtcattatgatgggtcctaacttgatatgattggtatccttattgacagaggaaatttggacatagaaacaggcatgcacacagggagaacaccatgtaaacatgaagacagagattgggatgatgcatctaccagacaaggaacatcaaagattgctggaaaatgaccagaaactaggagacaggaatgcaatagattctccctcacaaggaactaaccctactgaaatcttgatctcagacttctagcttccagaactgtgagacaatacatttccgtcatttaagccacccactttgtggtactttgttatgacatctctagtgaaccaatacaatcaacaggtctccagtctctcagactagaaaacacagactcattcctggctttttccttttcttaatcatctgtatccaatctggcactaaagacttaggtatattcctcgaaaatgactcctagcatctttaatctcattcaatccattgcctccttttcttctaccatttttgtctcagttcctcttgccttcactccggtcccacccttcagcattttacatctcacttcctgtaaaagtatctggttagactctcttaattgaagattatcttttaaaatgtataattcatgttgctttcatcatattagcgccacagacaagatgtgcttatagtggcatattgcttactatgcgaaatctaaggttggcatacatagccctccataatttggacccatctactctactcagtcttttgtcccctatatacatcatgcttatttcccactttgagccccgacccttttactccctcccttccccccaccatcaagatgctttcttatcttcctatcatctaaatctgttcatctttcaaggccctgatcaatttttcactgactgtgacaactctggcccacacctgatatctcttgccctgctgcattctaatcagtaccttccatgttagcagcaagtggtatttctaaaattttgtgtggatttacacatatttatatctctatctccatcagcttataggacatagtgcttgttaattaattggccaaactcttgaagtggaaataatggaaaataagaggtggggaaggaagaaggagattagattaatattaagggaacagaaaactttggccagaacaatgaaggagaattagtctaagtccatgttttccaaatgtgcttcctggaccaccagcatcgaaatcatttaggatggctgataaaatgcagattcctcagccctattacagacctattggatcagattctgcagcttagacatctgaatttgtaaaggtaacccaaatgattcttcagtataccaagtctgagaaccactagtctaagtaaacagagcagaagatgggtgctgaaagggaagagcttttcttatgtttactgggtacagtactttccatcatggctaacaagataatgaaataattttacactatcatgatttgctttgatgtgattgtccctcttcaatagattgctttgtgtacatcagtcctttcttccatggcaagagtatttaaagtactgcatcacaaatatgggctggctaatatagagtctctcaaataacagaaattttgtggcactccaaggaaagataactgagacttctaggctggttttactttcttcaggaagtaaaatctaaccagaaacataccataggttcctacaattcaagtttggtagcatggacagagggaaaaaaaaaaaacaacaacaacaactctgagatctcgttgcttaagcttttaattggaaccaaatgatagctaaaacatgtagccactttagataaaaactgaagaccttttcactggctcacaatgagcgggatttctgcagttgagtactacagaagtgagataacagaattagatacaatcgaggggaagaaaaatgcacagaagtccttgaattaaaatgaattgaaaccttctgggagaaaagctatttggtaagctccattaagtctattgtagatagctttatttgccaaagcagcatcctggcatgtggaacaggaaagaaaatagctataagatgatctgtcagggagtttccagtctctaaacgaataagattctgtgcagtagccaatacagcttttaactcaaaagagacacagaagcaaaatgcaattatataactctagtaagtgcattcaatctgagtctcccatatacccctctcctcctccaataactccacaaactcagcaatttatcaagtggatgcttaaacttatggcagcatttatttcatggtaacactgactaaatactgtgtacaatactgtagatactgaggtgtaaacaatcatacaagtgaaagattaatcagctataaaacatcctagctaagcacttaaataatttgaatagttcaattcttattcaactctgtgtttattttggctataagtttacagtatttatttgcagtaattagttgactatcctgaaaatgctagctaaccactgattacaaagggtttattcaatatagatagcagtttgtatgtttagggttcaaacatatggcaaaaatagaaaaaattcagatgtaatagctaataaatatctttttcaaagtctgacttgatgtttttctttccttcagagtttctgttcatggagtgaaaattctaagaccactcaagtggctatagagctgctgacttcactatacaagcactggaaccaggaaattcagatttgaattacaatctctctctctctgtctcttttacacacacacacgcacacacacgtacacacacacagcaggaacagtatacaactatatctccaatctctagtatagtgcttagcatgtaatagttattaaataaatgaactcatttaaccatcacaaaatccctgttagatgtttttttgtttgtttgttttgaggcagagttttggtcttgttgcccaggctggagtgcaatggtgcgacctctgctcactgcaatgtctgcctcccaggttcaagggattcttctgcctcagcctcccgagtagctgggataacaggcatgcactaccacacccagctaattttttgtatttttagtagcgatggggtttcgccattttggtcaggctggtctcgaactcctgacctcaggtgatccccacccacctcggcctcccaaagtgctgagattacaggcgtgagccacagcgcctggctgttaaatggtttttataatgtactccttacaagtgtggaagctgaggctcagtggggaagaagtccctcctaggtcaagaaggacagagttcggactagaactcaggtgtttcaactttaggtccagtggcttttccactgtaccttcctgtaatctgactcctaagattgtctggaatggtttgcctaaaaagagtagtcttctggatattttattatctgcaatggtaattctcccatccaagatagtttattatgaaattgaagaggagggtattatctgttgttcaaaaagtttgccctatgggtcccactaaggacctgtaacacggcctctgtctcagagtgaggttctgactatactaggttacagctgcttaaatgcccagcgctttttggaaaagaaagtccacttttaattaggcacttcaatgcaaggtatggataagtgaaaaccacagaaaatcctgtagccacagagctgataatcagccagtatgtacacatatggccttgccacttatttctagctggtatccaggctgataggttgatggccataccttactgggtattaaaagtttgaaaatatcatgtctgcaagtacatgtttattaaataaagaaaacagaattatctttacctgattcctcagtttcttttgtttctgtcatttcttctatttcatcatcagacatttccatttcttcttctcgcctgattcccattaattcatcattatgaatgttgcgaatttcctaaggttaaaaagtatgctttttaggtgggaattccttgaaaatgttgaggaaatgaatggagttaaggataagataaagcagcatttttttttgacatattaggaaaaaaatcctccaaatactcttaaggcaaagaggcatgttgaaagtaaaacagtctcagacaaagcagacttggttatactctgtcttgcattaggctttctttccagacccagagctccaggagtctatgattcttatattcctatcatattagacagtatttttggccatgaaagacattttacctcttacatggatttgtggactttcccttaagggttctgccattttcacctccccacgttggaccctttaattttgctgcttgccattctcttctctgtctttttatagttttactcaacataactcttaattgagtttttgtagttttagaagttacagcaaagatgagctttcaggagtaatattctaccagaccaaccttcccatggataataactataatctttggacaaaacacaaaacaaaacccattaactacttgatgacattggagagtgaacaaaagcagacatattctgaagagaagctgacacttggaagaaaggaatagcatagggtgagtctctcagtttttaaagggcaatttagtctgaggtagaccagagttagcacctcataagatggctaaatttctaatagaaagcccatagtctttatggcctaaagaactcaaggagagttcacggcagttacagccactggaaagtaagaagggaatcccagaaaggagacaatagaggcagggggaaagaactttaaattctgtatataagatctgctcaaatgtctgcatgagacccaagccaagaaagcacaaggaagattcccaacagcacagctaaggctaaaataactgaaatgacaactgagctggccatccaagagatagaattcccagcttgaatccaactaagtaaattgaccgttacgacaaacgaaaacaaagtcaacattctttgaaagaacatagcataatccagagtcttcacaacataatatctgtaatatctaggataaagcccaaaattacttgacatagaaaaactaggaagatatggcccatttccgaaagaaaggacaattaacagagaccaacactgaaatcacctagatgtggtaatttaacagacaagaaactaaagcagctattaatataactgtgctcatgatgtaaagaaaatatgtttataatgaatgaaaagatagaaaatctcagcagaggaatagaaacatttaaaaggagccaagagttcttttgtctgaaaataaaaagaaccaaggattcttttgcctggaaataaaaagaaccaagcattctttaaaaaaaatctctattcctctgctgagatttcctatcttttcattcattatgagcatatttcttttacatcactgagaatcgttataatagctgctttataatctcgtctgataactaccatatctgggtgattctacagctagaaaatgatacctgaaataaaaataaccagacgagcctaaaagtagaatagagatgacagaataatgagagaacttaaagagagagaaaaacaaatgtatccaatctgaagaacacagagaaagataaatatttttaaaaaacagagccttgggaccttgtgagattacaaagatctaagatacatgtaaataaaattgcagaaaaagaggagaaagaaaataattttaaaagatttgaagaaataagggttggcaatttctgaaatttgatgaaagacattaatctacatattcaaagagctcagtgaaccccaagcaggatatgtgtgaaaaaagtacatcatattaaaacagcagaaagctaaagataaactctggaaagcagccagagaaaagcaatacattatacagaggggaacaacaatttgaatactttgacttccttcagaaacaatttaaggccagaagtcagtgaaataatatatttaaagttcatgaagaaatacaaatatccatttattcagaattctgtattcagaggcaaattctctcaagaataaagctgaggtatattttcagacaaaattaaatgcaagaattcatcaccaatagacttgcgctatagaaatatgctatagaaaatgctgaagaaagttcttcaggctgaagggaagtgctaatggatataaacacagaccttcaggaaggcatgaagaacactgaaaatgattaagatcccatgataaaagtcactttaaaaaggtaagcacaacaactgtgcattttgaagcagcttgcaatcatttagaggccaattaatgcctgtcagaggcttgtcagcactgaactgagaattccttgcttggattagcctgtactgggctgtacacaggaaatatccgaagttgtctgtgaaaattgcctccatttaggggaattatatgtgtttcaaatggatttttaaataattaatggtgtagtcattatcacaaccaacatcctcctttttattcattttatcaggaaaaataatgatttctatctcaagttaagttttcactaaaaataaataaaagactctttttttaaaaagtgagctatttagtatcatcactgatagttaagaatagaaaaagaagatgctaacatagactctcccatgtgcttcaggggcattacttaaaatagaaaaaaataatgacttgcttgagaaaaatgaactttaaagggctgtgtcaagagagacttgctatgtcttattcaaacttattacacagagaacaataaaggaatttctcatttctgagaattcattctatctcaggagtctgattttcagttatcatcaaagagctgttaccggaaaggtgattataatgaagtttgacattggcaaattcgaatattgtacaacttaccgcattaggaaaagtcatggctttctagttgcctaacaaaaatgtagactattggagagtataagcagagaccaactctcaattcacaaacatgtcacataaccctgagaaagttattgtgtttctcagaagagtaaaatatgttccttctagggaaatgtcccagggcaggaatatctgagagctaagacatgtcctctagcttttcagcatccacaaaacatctttcttcttccagctgggcaaaaaagtgtaatctcttcttagaaacataaaaagttaaaaaaatatgtgatacagcttatctagtctttcacatcttcaaaaatccctggaaatataacagacctatgaacaaattttacctaaatgtttcaaagtacttcaggaataagaatcaccagttgctttaactgataataaagtaagggtaagaaaaactaaggggtatgtttccctaagtggttcagtcaggcaggcaaactggcagagctcagagccccctacccactagacaatcctttctagctacaaagaaactcaggctcatattattattcttctataaatacccaatactatatcacacgaatgagataaaaggtaaagagagcagcagaggttatggagtactatactaaagtaagcttatggggaacatttagtaagtgacagtactcctaaaaataaggagtgaggttttaattctttgaaaatctttcccttaaagcacttgatgtctgagctacttgtcttctgtattctccggttggatcagaaaagctctactttgggaaggaaaccctaacaaataccttcagagtgaagggctgaaaggtgacatgaaccccaggaaggcattctacctagtttggacataggtgcaggcaggggaaaaactctgagccactgaagagcagacagcaaaggaaatagctgtctcccagatttgccccattttccatcctggcattttgaatccagtgctgaaaccaaaagaatggtgatggcatgtggaaacatttttcagcaatttgcatttgtaaatctctacctgaaattgactgggtcacatcactggtagactacaacaaaaaaggtaagatatccctcctaaagtttttataccattctcctgcccacagtagatctgtgatatttttcatttcaacaatgaactgttagtgatttctggaaacacattataatgactgagtctgatctaatgataactttttctgaagcttagaaattcacacactactctataatggggaacaatgtactttcatatagaataaaactgaaatcggagacaggaaaatacatgaaaagaaccacttctgtgccagctgacatttttgatttatcataaagtaagcaaatcataaattgttacacattaattatctaactatagtttcacaaaaatgtatgtggatttaaattaatcttattcatgttttatgataggaacatgattaccagacaaatcagtttcttaataaatgtgtaacaaaattctacttagccagagtttctttttttttttttttaacagggtcttgctctgttgcccaggctggagtgcagtggtgtgatcatggctcactacagccttgacctactgggctcaagctatcttcccacctcagcctcccaagtagctgggaacacaggtgtgggccaccacacctggctaatttttgtatttttggtagagatggggttttaccatgttgcccaagctggtctcgaactcctgaactcaagcaatctgcctgtgtcagcctcccaaagtactgagattacaggcatgagccaccatgcccagcctaagactttcaacattaagaggaaaattggtggagaagagatcagacaagggaatggaaagcagaggatagggagatagcttctacacttatgtagaaatttgattctgagatatcatttaatataatgaagcaaagtacaaactcaggttcttaattaatgtctattatatgatacatagtggaaatacaaattaggtttatccaaattgtgttagtatgttttttgatggctgaaggccaacagccggtgttagtgcagataggtcctaaaccaagggtatgcagattatttgaatatctatctgcaaacagttcttcagagtttggaatggtaggcctgtaattctataaagaaagttattttagcaatcacagtatttcattttacaagaatactagtaatcaccaagtcccttttcctctagccccatggtgtaaaaccgcatctgagggaggatataagaggatatctcctagggcttattgttatggctctagtttttacacattatcaaagctttagctttgaatctaggccagctagagagaaacacataggttttaagtgattctgtagaaaaagagttcccacaacacacagaactgccagtaaagtcactatagacaccaacttttagtaaggggagggacttcattcagccttctcctaataccgttttcagttgtattagcagggacctcacacacatataaatcaggaacgtaaagcaatgaaaaagactcattagcaaactagtttgcttgacatatgctaccaaagtcagtgtctaagctccccaaaggcggaaactttttcttcatactccacatcctttctctcagcagagtaagaccgtgttggctgctggtagaaggatgacaatgagacaaggaacaggcactttgtgacatgaggaggtcattggttgacttgttctcagatgcaactggtaaaaaggttgaacgtcagaaactcactttgatgaaacccttggcttatgagttctatgtagcttggatgcctaggtcaaaaataaggcagcctagttgattaagtttttgagatgttctgattttcaaggggtgctaagaggcagccacaatttaagaggatggtttatttatttctcacaggatacctcctttcagtcctcacagttgcctgctatcaagtaaaagtttgcagaggtaaaaaaaaacaaggacaaaaataaaaacaaaaacaatgacttaaagaggcaccaatataaagtgaaagagatcttttaggtttagggaatgcaataccagagaaaggttatgagctatgtcccactttcagctggtgtagtactgaacaagatttgagatattcaaggtggaccttaatttaattcaatcaaacaagcgggaaggattttttggggtttctacagtctacaaggcacagcatgaaacatgtagctcctggaaagtcatgctggtcatgtactttatcatcaccactctgccaaggaagttttgttacaatattgggcaatagggtgcaaatatctcagttctctataggtcctaaggagtgtccagctcactggtacagctatctctactgtgagtctaattaaactcaagtatatatccgctagataagtaggcttgaaatattaatggcaaaaactgcaattacttttgtatcaacctaataactacacagacccttgatgaatatgattgatggataatattttatggccacatagtttgcaaaagtgttgtgacggccaggcatggtggctcacgcctataatcctagcactttgggaggccgaggtgggcggattgcctgagctcgggagttcaagaccagcctgggcaacatggtgaaaacccatctctactaaaatacaaaaaattagccaggcatggcggcgtgtgcctgtagtcccagctacttgggaggctgaggcaggagaatcacttgaacccaggaggcggaagttgcaatgagctgagatcgcgccactgcactccagcctgggcgacagagcaagactccgtctccaaaaaaaaaaaaaaaaaaaaagtattgtgacctaggcaaatcagcattccaaccagaggctcccttcctcctgcaaaaaggcaatgtactgtcacggctttccttaaagggtggggccattcagtcaacttcttctaacccaaagaggagttagaagtgtacgtgtatcaaagggaaggtagaaacttaatgcctattctgcttttctacaatcataagacctactgagcatttttctctcgacttttattcttctgaactgaagactggatattttaaatttagcgtgtgaaactcccctcctcctcttgatcactttcattacccttctaactccctgagggcaaagatcatttcattctatgttgcctatcatagtgcttgagatggagaaagtgatcagtaaacatctgaatcacaaagttgaattttgtttgttgaaggtgaacaacatgaggcagccctaggattctaaaaccattttgtgctacagtaagataatagtttccttttctcccctaattctttaaaaaacaagtaaagatgctattggctatttgtgactctaccaacccattggatggctgtcttcagggatttctttctagtgactcccagatccctttgccgtgccagaattgatggctcagatactatcagtttataaacaggatttggcttattttctcctaaatgcttttcatggttttcaaattgttctcacacaaacatatctcatgtattctcgtgaaggacagagagaaattactatccttattttataggttaagaaacaaagatccacaaaggttaaataactagctcgagaccacaaagcattttgtaccagagctcacagtgaggagaataatttctagtccatttgctagctttgtaattttgtgtaaatcacttaacatttttacgtttcagttttcctgcaggtaaaatatgaaatctatacctactcactatcacttatgaagctgttaataaaaactgaagtaatactatttctatttttcaaactttttacacatttcctaactcatctcatcctataagactggtttcattattgtctcgaatttacaggtgaagaaatagaggctgagaaaggctgaataacttgctcagtcacacagcactaacatgtcagagctgagatttgaattcatgtctggctctgagttcaatacttttttcacttcaccatgtctactgtgaggctcacacaggtgagataaccaatgtgaaagcactttataaatgtaaatatcttgtaaatgctatttaaaagttaaggaatatgacaatttacatggatagatataatgggactgctaccaggctggcaaagaggaccagaaatgtagttgaaaagttgctgcatatataaattgaaaatattgggacttggtaaggaagttgcccataggaataggaggacttgaggcatatgtaacaggattttcaatggcagatcagtgaaatctcccatctcagtttttaatctttgatgcagaagagcaatctaatcacatcacatttattctagtgttatgctaaaaatgtcacttgagtataagcagagaggtgtgtgccaaccttaacctaagatcagagtcctgttacctttaaagcttccacctataaagatgactaaatgaatttgataaaagaagctcagaaatttcaaagatccagtataacaccaggcggcttccgtccttcactgtcaagacactctaaaaaatgtaagacagccctaatattactaacactagaagcgcaggtcagtaattattgttgtacccaagactagctcgctaagagaagtaaacttataattatcccagctacattttcactactaaggtttccatccagcagaatgcattcaccacagcacaagcacatttattacccttttgacagcaggtggtctggacacagtgacaggctatagaacatatcttagtgtttcattagggccttattgtgaccatgggagcttggcactatttaattctggctaaactccagatcaataacttgttaacgaaagaaactgtccccccaaggggctaccagaataaaaagttaccaacctcagcttgtttgcaccacacgctgatgttcttccgctgggcttttgtgaagtggtcccatgccttctgcttggaggcggaatggtacacagccactatctgctcaactgcagcatcaaatcagcagttggatcaggccagggtatcatccagggatggaaaaagagaggagaaaagaaatgaaataaaagagaagcatcaggcttgttgtatcttgttgttatgacactatactaagctgtggttgtgcttggaaaaggctacatgtgttggggtactttgattttaaaggagacgcaaaggaaaagacatcaacatacagaaagacaaaagggaacaccagaggtttggggtaaaatggtaacaactagagttttaatacaggcattgtgaattcatggaggcaggagaggaagagtcatagcaaatgcacttttatttagtacttgtctttagtttagtactagtgactccacacagcatggaagaaaatggcaaactgtaccagaaactctctacccctggctcctttcatagccctctgacacacacttggatgccttgcttcaacagaattcatgcttttactattctgaggtatgtttaacaagaagcatcaaatcaaaacctaagatggattgaatcttttttaagtctaccaagatagactcgttgactggaaaaatataagttttagggaaggatgctgtgtaagtgcggtcctagagagtatttttcaaggtctcttaaaatgtcaaacagggaaatgtgtgcagatgttctggggctttatcctaatcacagttcaagagaggggaagcttagacatgactcctttgggaaaagaaaagcaggacaagagcccctgtctggttgggtgttcacagtaagaaaatccagaggtattattttttttttctttacatccctgtttgcaccctgtcttctaatgacttaaggatttatagtcccatgatgcgtgctgctttctctttttaaaaatttatcctaaagtcctgaagacatgtgcttttgcctcctggattttatgcccatatatactttcaaaatacaagtggcaaatggaacaactcccccttaatcacaattatgtatgagtcaagtacagggaagtcaagtttggaaagagtggaccataattgtttaaaagcaaaatcataaaattatacccttattcttaaggtgaatatactttcttactgaaaaaataagagtgtataattttataatgtggtaaacaaaaaattacttgataatttatctgatctggctcatttcagagaccttagataggtttggagcggaatttctttttaaaaatggccattttggtagcttctcaccttgtcccagtgtctatgacatccagcaaaggtagcagaagaaagtaaactaaataaaaaatgtagaagtagcaaatttgatttttatccaatcaccttgggaaatataattacattgatcattgaaatggagtttcttgaaggcatattacatgatgataattatacaaatctgaagaaaagcagctttaaaatgctgatgctacatcgtaactttagcaataaaatacccagccctctattgaggcccagggctgtagaagtataggatgtggcctaaggatcagtgtttctaaggagttgaagtagatataccagagaaaatgaagctagcaggtgcgcacatgtctcctgtgaaattggagcttgggcatttgacaatataaggagagcacaaggcagtgaaaaagggagccttgagccttaacacaggatggctctggaggcctgagctcccatagagagcaagtgactaagtgaagtgacttattctcattccagcagaactctaagttccactcacattgaatgagaattccagaaagggcctgcttgaacttctcctttgcttcttccatatctttctcatgggcagctttctcgttcaccaggcggcggacatggctgttggccgactggatcatggagtagaagttattggcgctacgacggttgacctctcctcgctctatccaggtaagcaaggtctgtacagcttctgagaatttggaatcatctgaaaaaaatatatttttataaccaacaaaggtaaccaaattttgatctattttcccaacatgctggcaaagagggcatcatgatttttggcagtgatgggtaaatgaattgctgaggatgaggagccacacatacacacatgtgcacacacaggcagtaggcaggcagacaaacaggaagaatggaaggatcaatgtagtcagactggttgtggtctgtgatgaattttcagaaagagaaatgtttccttgaaaaaagttttctgtactgatatataggtttcatgtattgcaaatttcttaccctctctgattgtgtgtgtgtgtgtgtgtgagagagagagagagagagagagaagggggaaagggggcagaggggagacagagagacagaaaaaaccatgaattagtgagggaacttcagaattctacagtcctgtgttttaatgaggaaaagcaaacttgaatcctgagtttaacttgaatttaacagtaactttaccttggatccatggaattacagtgttgggaggagcctcagggaagagttaattaagtaggtcattctttagatacaaacatgcacatcttcgaccttttatagtatcactcctgtgttcaatccacagccccaggccttccactcagtcccactcacaatctattttgatgcaatttattttatttctatatttctccacatccttttttctcttgcatgaagaacctccatgtagatttctgcagctagttaggagttattctgtgattagttaagatagtagcacagctcttccaaagcttctggttcagctccccaagatagccacttatgccttctgttcttaaaggctccagagagggagagtacatttggatctattgaagcccaattcaagggcttcacatccttctctggctagaaacccttatgttaaatggaaatttccttcactgcagtttgaacttcttgcctcttgcccctttttcagtgcagacatataacaagcagtcagcctcccctttatagcagcttttcactttattacttagatatagactttatgttgatgctcagtttttgcttctcttgaaggtcacacacccattaaattcatttttttaaacttaaactgatttgtttggtgttgtgtgactaggcaagtcttggacctggcgtcttaccaatgctttcagcctttccagtttttcaaaatgtaccattatttctgtgcctctattctggactctaggttttctgcttttcccttaaagaaagtcaaaaccaatttcttacatgtgtgaatcccttaggctatgtggtacaaacatgtctggtgaaggagacctatttggaaagtagggttagcagtatcttgatgagttgagaacacaagaagcagggaaaattcataccattagagctggattggtgttaccaataagatcaatgggacaccagcattcatccaataaaatcatctatactcagaaaatgagaaagactggatttgagctactaagacaggagaccaggcagagcaattaatgttaaattaacaaaatggctgagagtcaaacaaggggaacaagaatcaaaactaatgggaaagcagtctgattaagcaatgtctacacgtttccacagtcactgttttaaataaactggccttttaaagtgatttaaaagtctttatgttttagttggtggtggctaagtctttgagtcatctaagaagaatgtacagcatgactactttctggacctccattttctcatctttaaaacaagaattttaccagagtttttcaggatcacatcaaatcctatcatcctgattcactcatttgacttggaattataacctaacttgtatccactataaaagagggcgcttacaggtcccaagtcatagatcatgcctaaaagtctctgacgtggaaagtgaggaaaacttgtttatttctagtcacctgatgtctgaagagaaaaatgccatcccttgagacaatgaaggagcagacacaggtagtagggataaatttcctggttcttgagttactaggtacacctctctatctgcaaggctccaacacaagaaatgcttagaatccattagtaggaaactcaaagtgtaactgtcaacaatgcaattatatttatgacacttctctaaagaaaagagttcttttaatcatgaagcttgagtgcctttgataccttttaatttttcagcaacaatgctgcattcatgatctgaatagtggaccactgggggtggagatggtggacgcaatctttcttcttccattcttctacgatggcgctcctctctggctagcatacgctgtttacactcccactcatacaggtcatctcgagcctgtgcgaaatcaacgtggagtctgcctgtgtccttcttgtcagtactagagcccaggcgaatgcggtaacctaagtccacaggagggtgaaagggagaggagagagggagagaaggagagaagtagagggagagagagacagagacagagagagagagagacatgaaagactatacatacttttccaagttcagtgtttcagatgtcactgcagcagttccaagtgaccacacaactccaaattctctccccatgcttagcaagtaaatcatcaaaagatttagattatctctgataatagctcacattctatgggttgggttagtcttgttcttaagagttccattcctccatctaataccttacctctggctgaggttggctccgtgggtaatagtatcaagcatgatcgttatatggcaccaagggctgggaagaatggaaaaggtggcctcaaacgaacttgtctttaaataaattcaagagtgtccattatactatcacaaagattttggtaaaacttaaatgcattaacttggtattttaatccctaaaattgcttcctagaagcatttgtcaactgtgagccattttttttctaaaaaaaaaaaaagatggggagtgatgtgtgacccaggtgacatataatttgggatccttaaaaaaaaagatgtagtgtgattataatatagtagtataggactgggattcagaaaacctgattcaactccatacctcctctttctgtgccagctatacttacccaagtcatgtatcttaaaaaaagtggggaaaaaactaagtactttttcagtttcaagagctcagctagatacttccataggaatttatctcatttcattatcagcacaagcttgcagggtagaagggtagaacattataccaaacagaaaactgagcatcaaaagaggttagggaggttaagtggcttgccctgggtcagacaattagcaaacagtagagctggctcttgaatccaggacattagactctgtgctttcctttattctaacctgcctctcaagaataatacccaacatagacttttgcttctggctaagatagagtaacgggttagatttgtcctcctaccttaaacaactaaaaatatggataaaatatatgaaataatgctttttaaagaactgtacataagacaatgaagacagggatcactgagagacaagaaccaaatgaagtgatccctatgattgccccagtttatttcctaataagaaagtttcctaataagagagtttttgggcctcagcacagggaagggaactcagacagggcacgatggtgttcccaagttaaggagactgaactgggagtctaggaagactatggaaatagagttcataaggcagagtaccagaaagaagaaagctgcacagagaaagagcttcagagatatgcagagggtcctccactattatttagctgagtactaatgtctatatgtgtgggaaactacctgagcattagaggtaacaatccctgaaaagctcccacagggttgggaatagctccttttcctaccagccagagcagaaaaactcacacttctggtactgggtgatcagaagggttctgccttaatagtggagaaaaattagccctaaactcctctggtcttgctgaacaaagcttaagaagcaagacctaaaaggaccaaaattttcccaagttacttaactgcatttagaacaaaactcaagactatttatagaaataaaaatatgccaccaaataaggtaaactttaataaaaaaattacttggaatgcaacgatgcaggaaaatatgacccataataaagattttaaaaatcagccaatccaaacagacccagaagtgatgcagataatttaattagtagataaggatacaaaaacaatgatgaaaatttgatttcacatgctcaagaagctagagaaaagactggtcatactaaggagaaacatgaaagatataaaaagagccacaatcaaacatctacaggcttaagctacaatgtctaagttgaaaaaaacatcaacagacaggactgatggcaaattagatgctgcataagaaaaaaattaatgaaactgggggctcccagcacctgagccttctgcctgcacccacctgagaattctaatggtgactggggaccagcctgccctccctatcgcagccaccacctgaaccctgggggcctgagaataagcctgctggcccggtcctggtggagtccctccagggcccccgcacaccatccagtgggccacttaggggcctgggaattgaaggactgcttagctcagtccatcactgctggcgcctgaccacttggcctgaggcctgaggttgggcccaagcagccggcacccccacagttgcctcccactctcacatgctgaaaggcagagtccctccccgtctttacacagagctgtgtaaaagaataggtgagccacaaagctgtctgtactgggctgagggaagagcttcctccccaaagtcactcctttcagctacatggtagcctggagatagatggacagtgtgtaaactgagtcaggagccccaggagagggttgtgacagagaaacattgtgatcctgcctgtctaagaagtggagctgatgtggccccctcatcccctgaagagacctcggcacatttctccaagagttcccctagccactcctgtcaggggtgctgcctgtgctcatcattgggttattcgtgggtgagcttgtttgtccagctccacccagctttgtcctccatccactctccctgggctgaatagggaacctggaatttcacagaccagcccatcatctgaaagaacagagagcacctcacagtaagaaaacatccagtacataccgatctgcttctgccacaggtggctcttacctgtaggcgccacctactcaccaggaggttaaactgcacagcacaataggacacctgctgacagaagtgcacagggctaaagaagcaaagccaaaggaccctacccaacatacgctacagtcacatcttcggagttgggggacgtcccatccaaatgaaattagattcaaaaataagaagtgacagcttccccacgtgaaaaggaaccagtgtaagaactcggggtgttgcaacaccccgaaaagatcacactagctgtctagcaatggatcctaatgaaaatgaaaattctgaaacgacaaagaattcaaaatatggattgtaaggaagctcaatgagatccaagagaaagttgaaaactaacacaaagcaacgagaaaaacaatgcaggatatgaaagaagagatagagatcttgaaaaaaaaaaacagaacttagggaaattaaaaattcactgaaggagttagaaaatacagtcggaagctttaataacaggctataccaagcagaagaaagaatttcagagcttgaacactggtcttttgaactgaccctgtcagacaaaaataataaaaaaggaatttaaaacaatgaataaagcctttgagaaatttgggattctgtaaagcaaccacacctatgagtaataggcattcctgagtgagaagaataaaagtaaaaactttgaaaaacatatttgagggaataatccaggaaaatttgcctggtcttgcaagggatgtagacacccaggtacaagaagctcagagaacacctggaagatattttgcaagaagaatatcatcagggcatataggcatcagattatccaatgtgaaggaaaaaattctgaaagcagcaaaagagaagcatttcttttctcctgtctcactggattatatgaagattgggcttttggatgtgtgaatttagtaatactttaaaatgtaaatgcaggctattatcctaagtgaaataactcagaaacagaaaatcaaataccatgtgttctcacttataagtgggagctaaacaatgggtacacataaagatagataatagacactggggactccaaaagtgaagagtgtgggaggggaatgagggttgaaaattaactattggatataataatcactatttgggtgatgggtatactagaagcccaaagctcactattacacaatatactcatgtaacaaacttgcacaggtgcccccgcatctataatgaaaaaaatgaatgaaattgaagacctagcaatagaaactatctgtaataaaatacagaaagaaaaaagactgaaaaaaaaaaaaagaacagaatagcagtgagctgcgagacaacttcaaggggcctaatatatgcctaattggagcaccaaaagacaggggaagagaacagaaaaaaattaaataaggggagaaaatttttcacatttgatccaaactcacagatccaaaaagttcaatgaaccccaagcacgagaaacaagaagaaaattacatcaaagcatatcataattgaattgctcaaaaccagcaataaatatctttttttattattattatcatactttaagttttagggtacatgtgcacattgtgcaggttagtcacatatgtatacatgtgccatgctggtgcgctgcacccactaactcgtcatctagcattaggtatatctcctaatgctatccctcccccctcccccaaccccacaacagtccccagagtgtgatgttccccttcccgtgtccatgtgttctcattgttcaattcccacctatgagtgagaacatgcggtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatatgtctttatagcagcatgatttatagtcctttgggtatatacccagtaatgggatggctgggtcaaatggtatttctagttctagatccctaaggaatcaccacactgacttccacatggttgaactagtttacagtcccaccaacagtgtaaaagtgttcctatttctccacatcctctccagcacctgttgtttcctgactttttaatgattgccattctaactggtgtgagatggtatctcattgtggttttgatttaaatatctcaaaagcatccatggacaaaagacacattatgtacagagaaacacagataaagataacatcacatttcttgttggatacaatgcaagcaagaaaatggtggaacaacatctgagagaggacaaacatctttcaaaaagaaaggtgaaacactttttcaaatcaacgttgaaagaattcatcaggaacagacctgctctacaaaaaatgttaaaggaaattcaagcatagggaaaatgacaccaagtggaaatatggatctatagaaaggaaggaagagcatacacaatgtgtgattccatttatgtaaagttctagaaaatgacactaatctgatagagaacagataaatggttgcctgaagggagagtggtgaggggtagaaggacaggattgcaaaaggggtgtaaaggaagcttttggggataacagacatattcattattttcattgttggtgatggtttcatacctgaatacatatatagaatattatataattgtatttttgaaatatgttaagatcattgtatgtcaattattatacctcactaaaattaaattattatagctaattaaagctgttacaaagaataatattacccagtaatgccaaaactgtcatacattctttttagaaaaaggaagaatgaatacatttcataagcaagcctttctagggctctttacagtttataatacacttgcacatccattcatcttatttgatcatctgagccatcagaaaaatggggctaccaatgattaccttgcctattctcccagaactgtggagaggatcaaatgagaggatgagatgaaagctctacataaacctcattaaagatgctacaatgctatggggtgggtgcactgtgcacagtgccagctcccaaaggtgctccaattccatcagaaaaaaaatgaagatctccacattttctagcccccttttgtaagggattttttttttgtttcttttaactgctttcttttacaaaatgagataacagccaccccattcaggagattgctagcacttgggcactttcagggggacagattcaaatttaaagggcaaaatttagttgttttcatatcactgatggaaatcccctttcttttggcagccctaagaatgtttctaggaggtggctgttaacagagagctgattttggtgatgtttagatggatgcttcctgaacagtatattgtcttttaagtacacctacgcagggttttttgagacctttatgttcttattaaaatagtctcgtggaatgctctgttattattaagtgctgccgaatttttggtaattagattctatagcacttaccaaatgtaaaaagagtattctccatctacacctcctcctttccttacccatgttaccagcctactttttcaaacctttgttaccttttccctggcctattacaacaggcttctaactgacctcctctcctcttttcacatctctcctctaatacagttttatatagagctgtcaaattaatcttgcggaaataattatcttccttgttcaaaaatttcttcaattccctattacctgaggagtaaagacccaactgttaagccttttggagtgtgctaataactgatattttgcctcctcctctcatgtctacttagtaaacaaaccactactcactgtttcctgaatgtttgccaaagcttaccacctttgtacttttgctcatgctgttttcatgccccattgtccacaagcaaatgttttccctttgtcaaagacttggtccaaaagctacctttcttgatgcccccagttaggagtcagaaatattctcgttctccctctcctaccttcctccctcacttcctcctccatggcacttataacttttaatctcttattagcagtgtgtgtatcatatcagtgtattgagtaatgcctggcactaaatacatttttctttaataaataagtgtatgactacatactaaccctaaattcattaaggggaagaactaggttttactcattttctactctgcatagcatctagcacaagagtttacagaaaaaagatgttcaataagtacctgttataccaatgaagatgctgtcatcatgaaatgtctagcacttagactcaattcttccaaaccattactgttaggcaaagaagtagttcaatgtggcagtattaagagctggggcctttaagaggtgattgggtcatgaagtctctgtcctcataaatggattaatccattcacagattaatggattaatgggttgtcatgagagtaggactagtggctttataagaggaagaaagacctgagctaactctctgcagagagcaagaaggcccttaccagatgtgccccctagaccttagacttccagcctccataactataaaaaataaattccttttctttataaattacccagttttgccaggcatgatggctcacacctgtaatcccagcactttgggaagccgaggtgggtggatcacctgaggtcaggagttcgagaccagcctggccaacaaggtgaaatcccatctctactaaaaatacaaaaattagccgggcgtggtggcaggcgcctgtaatcccacctactcgggaggctgaggcaggagaattgcttgaacccaggaggcggaggttgcggtgagccaaaatcacatcattgcactccagcctgggcgacaagagcaagactccatcttaaaaaaaaaaaaaaattacccagtttcagatattctgttataagcaacagaaaatggaccaagacacaccctaaatctgaatttttactataaacaggagattttatgcaaagtagttcttactatctccactccaaccactgtactatacaggccaccatcacttctgggttagactaatattacagctggttaacttagttcccagtcaccactcctgctcatacctctcagcccatcttctgctcagaagtaacatttgtaaaatgtaaatcagatcatgtcactgaattccttaaaatcctccagtggcttccagaataaaactcattgtcatagttgcctgcctttcagatttcatttccctccactccctctctcattttctatgctccagtcatactaactttctatcctctgcttgaacataccaagtccattttcatctcacggactttggcttggtgttccttattttggaacgctcttccccaagatgtttacatggcaatctctcttcacattattcaagtctcagttcaaatgtcagagaagacttcctttcctaacaactctgggtaccttaaccttttttatcttcctcggagcacttagtactgaaagtaacttatttatttgttttcatatatattatattttgccatttccagaatgtaaaatccttgatgacaggaagtctatctgcctcaccctttgctgcatccccagcaacctagcattctgcctagcagtcaataaatatttgacaaataactgacttccataactatttatgagtatctacttttgtgccaggttatgtgctagatgctggggattcaatgttaaataagacacagtccctgcccttaaggatttcacgttctggtgggggagatggatgtggaaagagacagttctagcatggtacagtaggtgtcatgttgggaggaagcaccaggtgctgtgaaagccctgaggaaggagtgcctaaagcagtgctgggcagagtggggagacaggtcagagatagctttccagaggagggtgtgcttgagctggagctttagggggtgtgtgtggtgggcagggtgactctagtcagaggaaaaggcataaaacaccatggcacattctgggaattcgagttcacttagtgtggttgggacatggtgtgtgagggaaggaaggactgggagatgactctaagaaggacagcccacagtcaaggcctttagatgccacatgtgaggagtctggatttatcccatagacaactgggagctactgaagagctttaaaggaagaagttgaatgggaacattcagtttccacctctgaaggcaagagcaggtaatactaagcccaaacttatctgctatagacacaaatagttctatctttaatatctgcgttgtgcctggtgggcacaatcctcacatctaaacacctaccagacagatacagggctttgtccaccatgtactcctcagcaaagcgaatgtggcagaagttcttcttgctcttgcgaatggcaatgatctctccacactgctcgaaaacttccacaatgatttgctctgtcccattttcaggcagaccacccacaaatactgttttgcatcctggtggtctttctcgggttgcaggaggtgggagatctaagttgtaagggcaaaaacatttgaaattaaaatgtttgcttgggacagacctcttcgaaatctaacatttccctgctatccctgtcaaacttttgtctaagagtgtcagaaggatgtggcctctgaggtgttcatctctgctccacagaaaactgactgagtgaacctgaaaatcattttattcaatcgtttgctgaccatgatatctggagcataaagacccaggcctatttgtctgtcccatccagagtcctttagttttgttcgttacttttgttgtgacaatccagctatgccaaatttttagtcatttttattaagaaattagtgggagaaaatcccactcagtttaaactgttattttcaagagttctcagaaccagggttcctgaggaaggatttgtttaattcagattgtagttactacattctctctgttaatgctttttgaaggaacagattcaggattaatttgacaatgatggggtacctacttacaacaatgcctacagctgtcagaatgatttggtttcacaaaatcagtcagagtacaaaccatcccttttatgttgtttttttcaatatcagtgagcctttcctcaaattccttgctggagaggtgaggtccagagtctgtcttgcagcatttacagggaaatatgaaagacagcagagaaaataagctcgtctgggaaatcattaactaaagtgagataaatttggccatagagaatcattaaaaacctacttaatgagatgattctccctctgcttcaaaaaaatatgcactcatcttaaacataaagcctgttctatctgccagctctttgttgctatttatatgtatcaaagcaatttccaagcaaactcctacagtttgtagcccaacaaaacaaagcatgatggtcatgggttttctagtgttggttttgtatccgcaaggatttattttgtgtaatccattcttttccattcagctcttaacaacaattctcctagctcaagatttggagagctcaacaaccagtgattatagctcacatgcaaaaataaatgagtcatgttcatagattaggccaaggcccccaacctgactcttatccaagttggcaagcagttgatttgggagcctccttgggtatcaggatctctagcttcctcactttgctactactctctgtcttgttggtgtggctaagaataatcagttactcataatactctctttccctgtatttggtcaaaaaaaggggtaaagggattcagggaacttacaaactttctgttaatttttacaagtctgtaatttcaagacctcactgtactggttttttgttccatatgaaaggattagagggaaagggaaaataacctagtgagcaggaatctgaaatgtcttagtcacaagcactgaagaggttgtagtttgggccaaaatagagaagatgaggtctagaattgtttgagacttatgcttttgagtttttaagaactggaagggattctagccatcacacttccagtgattcttaactctggtggcacatttgaatcaatttggaagttaaacaaataatgcctgggtcccaccccagtgggtctgatttatttaattagtctggggtgcagcctgtgcattcgtttttttttgtttttgttgctttttaagcttctcaggcagttgtaatgtgtagttaaggttgaaaactattgacttagtctaaatctctgatattacagaggaaaaagcttagtgaggttaaatgtctcattccaggtcaccacattagagagaaggaacatgaacttggagcaggtaaacctaaatgtaaatcttaacttcataactgactgtataaccttgggaaaattatataacccctgaaaacttcttccttcatctttaaaacagggatgctgttcccaccttacaagggttattgtaggataaccgataatatactgtctatattgcatgtggctcaatgcctagcacttggccggttcccaataaatagcagtcattgtagcgttattattatttactattatagaacccaggtttcttaattcccaatctgggactttctaaagtcctaccagaagtctggagtagagtggtagctaagacctgaacttctaaacttccagatcttagtgtcacacagatctttagacaaggctgggtttgagaaggaaccactcatatggatagagaaatctacagctatgaagatacatatggctttgaccatggaacacaacccccccccccaccgactatataaggtaaagaatttccaagagtatccatatagttagaaccatgttttaaaattagagactttagaatacaatcctgtttcagaatcaaaaaggcttcctaagtttactatttaggagaattaggtggcaaagaatccttttgtgaagttagtaatcacttttataccatttgagtttcctttagtctacctttaggtccactgagagactctaaaaagcatgtggttactgtggcagttacatgtaacactgaaaaggcaaaggctccatcccctggctacatttgtgggatttaaaaattctttggggggctgaggtgggcggatcacgaggtcaggagatggagaccatcttggctaacacggtgaaaccccgtctctactaaaaatacaaaaaattagctgggcatggtggcacgtgcctgtaatcccagctaattgggaggctgaggcagaagaatggcctgaacctgggaggcggagcttgcagtgagctaagatcttgccactgcactccagcctgggtgacagagcgagactccgtctcaaaaaaaaaaaaaaaaaaaaaaaaaaaaaaaaaaattctgtgatgaagtcatcaccctatttaggtgctgtgattcttctgtggtgactgttttctaagtaaaagggcataaaagccactaagagtaatgtcaagaatgctgaggatttatttattttccttgggtaaatgtagaaagcctctttaatagcatttgctgagatttaggggtatgccaccaagcagggcaatgggctatactatcttccttaatggatagtacccattccttaattaacagctcaaagcactttgtcgtctgggcctgattttctaatcccactgaaatacagtgatcagggcacagcaatgataacccataggagagcaaattcaaagcccacctattaatcaggtaatgtgctaagctctatagcaccccaatcaccactcaggatggagacaaagaaaagttccatgtacaaagattcaagataactgggaataaaaagaactctaatctctggtaatggaaaaggaggagcttttagcaattctaattatacccaagcatctactctggggagctatgttggggcaatctgagtcattgctgatctttgagaagtgaggcaggaagcagtatagagaaccgataagccacttgaatcttgcttttcaaaggagcatcacagatcactcagctggtttgccaggatttatatactgcaaagtctttaagtcgattttattagacagctcaagattgaaggtcccctggacaatcagcaggggttaaatgtatcttaatgtaatcccaactgattggaaaaattagaaggctggggaattttaattaatgctcaatttctctaactctctttatagcattcagccctgagagtcttcccattttgatatggtaaaatgaaaacattgttcttgctctttttctggctcctgggtattttcccatgttcctggagacggatagcagatgatattccattacttattccctgttcactgttatttcccagtagactcaaaatgtaacctctccatagaaggtctaatcgctgaagtgaaaaatcttggcaaaatcaaattttctggagagaatcgtattacccttttttttcaccactaagaactgctaattgggaattcagtaaatctctgatagacactctgtgaaaaaaaaaaaaaagtgtgttccagggcacttatttttttcttgttatatctcagtttcctggaaatcagagaatgttgcttctgcaacaatggggtactcactcaccatttatctttaggagactggtacttggtctgctccagtctagtttgatccattgactttttagaccaggtctgattttgcctagtctacaacagagaagttaagatccttatcagagatcttatggctatttagtggtggagagctgggatatgaaaccaggctggcctgtgtcacttctgagcttgaaaacttacccattatgctatagtgcctgctccagagaaggtacaaagctctacatgctacctgccaaccagcccttgcttttcctaatgcattttaaagggcttttgcctatgtaaataattattgtggtagctacatttttaatgtagagaatcataactttagagctggatgaagcattagaggtatctaggctaatctaacacaatatttttgctttacacacaaggaggttgagaccaaggaggttatatgactatccccagatcccacagctagttagtgacagacttgggaatagaacacagttgtcttgatttataaactggtagtctgtcctctatactataataccattttttgtacatttgatgtagacacacccagaatagtctagtaggcagttggctacatgtatctgaagcttagaagagatatagactaaaaatatagatttggaagtcattagcatgtagtagtaattacctcatactctcttgctttgctttctagacctctgacccctccttctgtcatcatccatccaatcctccctcccaccatcattcaacaaatatttattgaacacctactatatgtaagacacttttctaagtgctggtgatacatcaggagacaaaaaagacaaaaattctgccttcgtggggtttatattctacaaattatatagttggttaaaaggtaataactccagtatgggcaacatggcaaaatcctgtctttaaaaacaatacaaaaattagttgggcatgatggggcatgcctgcagtcccagctactcgagaggctgaggcaggaggatcacttgagcctaggaggtggaggctgcagtgagccaagatcacaccactgcactctggcctgggcaacagagggagaccctgtctcaaaaaaaagaaacatgttttataaaaaatagagaaggtaaataggattgggactgtggcagagagataatttttaaataggttatcagggtcactgagaaagtgacatttgagcaaagacttgaaagaagtgagagagttagccacgcagatatttagaggggaagtgttctagctaggtggaagagctagcgcaaaggccctatgatgggagagtggctggtgtgttcatggaacagcatgaaggtcagtgtgaccggaacagaggaagagatggggaggagagtaggagatgaagtcaaagagacaatggaggggaggaacagatcatatctgaccttctaggcaattaaaaggactttagtctctattgtgagtgaaatggggagccattcaagggttctgagtagaggaattacatgatcagacttaggttttaaaaggatcactctgtctgttctgttcagaatagactgtagggggcaagggtgaagaaggaagactaattagaaggctattacaataatttagaaaatgaatcatggcagatacaaactaaatcatagcagtggttattgtgaatatggaaggattacagacatatgttgttaggtagactgacataattttctcacagattaaacgcactgtgtgagggaaagaaatccattagatttggcattcactatttaagtgaaaatgccttagagtgattcactacagttttagttccgataccttccatgtggaagtgaaccagaaaggggtatgcttgaagttgggctggaggagagtgtgaggagtatgaggtcaggaagtagttgaacctgactaaatggcaggtatgtggcaagtagaagtgatggattgaagacagtcatatgaagcagacaagtaaaaggtttttgaggtcaggagttggactatgaatctgtgggcagtgggagccacaggacaattttatggttctatatatgtgacaagcacttggatgaaatgtcaggtgggacacaggggagggaatggatggcaaagatactttctaataaagcaacaagaattagaagcagaccgtatgagtccctgaatcacaggaccttattgctgagaggaatttcagaggccattgagtgtaagagaatataccagaggcaggcaggagtaaggagtggggtttataattgatatggttcggccctgtgttcctgcccaattctcatgtagaattgtaataccccatgttagaggtggggcctgatgggaggtgattggatcagggggtggatttctcatgaatgatttagcaccatccttttggtgctgctcttgtgatagtgagtgagttaccgtgagatatggttgtttaaaagtcaggagcacctcatccccactctcttgttcctgctcctgccacacgagacacctcgctccatctttgccttctgccatgattggaagcttcctgaggcctccccagaagcagaagccactatgcttcctgtacagcctgcagaaccataagccaattcaacctcttttctttaaaaatgacccagcctcaggtgtttctttatagcaatgtgagaacagactaatacaataatcaaggcctgatcaggcagggttggtgggctgagatgataaagggttcagtcacaccaaatccctgttcttcctttcctaccctgctcttcccatctcaccttcacaaagcaatgtcttggggccaccaacaacaatgtcacttttgccatgctttcagcagagaactaagagaagcacttctattagtgttttctccacccaagtaatccaagcccactttgaacaaaactcaagttctaaaaagcaaacagaacaccagtttactttaagctgtgtcaagagttttatgtttgaattcaattccaaggccaggttccttcccagaagccaccaatttactggtgctagttgccccgtaagcattctcaatacaaggatgaagaactaaaagacggagccatgggggagatatgctgccctctcactctgtgagaggttcttccaactcagaactgtagaggcatggctgcaggtggggaaatataaaaatgtatttgagagatgtcagtccgtttcttttactagaggctatcaaaagttagagccttcttaagctatatatttctagattcatttgaagactgctcaacaatatggtctatgtgtcataaacaaggcatctgtactttagaaatttagaaactgaacatcctgtaaagtaaactactgcaaccaacctggacattacaggttgtgagccatcctgttagcttagatatatttgagacaatgaaagcctgctgcaggctgattatgcgataaatgaatgattaatcagcaggattctaccctttcataagcaggaggttttaacactggcagtgcctaagttcatggctttttgtgtagaaaaggtactatcaggaatacaactttctctaatctgaaagcaacatgctgaaaggtaaaaaaggccattgcccacttgtagggacagtggaactaagagtaagagacagataaaatggtgctgctcattcacttaggcactaaacacaaatccaggaatggccatttgagctggcaagtaaggcctgcaagggccatcttattctccattccctaattctccttgtgacatactagctcttctctcaatacagtcctctgagatgctggcctcctagatttcttattggtctggaaggatgtatcttgttgacaaccacgttcaaaaaccagaagaaagcataaagatctgttttttttttctagcaaaagaggccaagatgatctatccaaccaacctgattgattataaaatcctctcagttatgagcagaccatactaagtaaaatctgggtccctgccagggcttgggccatgattaactgattcctattaaaggtaggagatgaaatatttgtctgaagtcacatgtcaaagattcatatttatcctgataaggcaaggtcatttgatctatgccctaaaccactgaatgtatctcttaacaaacagctctaatctttgtactgcagtggtggttcccttggtatgccacccagtatgactagaactatggaaaaatcattaatgaggcttggggcacatgcagaatcagcttctaatcactgaatgtatataaaaccccaagtgcatctggaaaaaaagttttagtcaattattattagtgggacattttaagtaaaatagggccaccctatctttacacatgttttaaagtgaatctaaggagaagcctcctcattactgacaaaatggatctctagattacttccacatgaactgcattgactggtggctatgagtagtgtgacttagtctcaatattcctctttgcccttccaatatgttgagccatgcctcactgtatattacaacccatcggttgaatagcagtggttcgagtgatgtatgaatagttgctagcagtggaagattcttagcaccaaatgtatattctcatgtgcttcagaccacactctgtctctgccaccatcagcacatgcggcagttacgaaaagaaaagactgcagatgatggtgttgagcaatctgtatgcttccttctttactaacacacttgaattccttaccagatggcattagaaacatgtatcatttgtactgcaacctgcacacaaaagtctactgttgtgtgcataaaattcaaccctgcctagcaagagaaaattttcctgtcttctgttctctaggtgaagctttcgtacaaacatctatgaagcccttgggtattcttttgagaaagaagaaagctttcttgtacactaaaatattgtgtcttgtgtggagaaaaaagcagaatattacttggatttggagggaagagcgtgcagcttttacagtgtatgatctcttttactactggcatatctggaggaattggtggaggtactattcccaaaccaggcatcattggagttattggtggaattccagtcatcattccaagagcaggatcaaagtctaaaaaaggagaagagagaacaataaatgacaccaggcaaagttaagtggagatagaatgttactttgtaagcttcaaatcaaaggcctttctaagacagaggcaaaatatttaacaagcatggtacttagtattcccaggtcttaaatattatcttatagttgtgcattttcctttcaggatggggctgtttggtttgaccagggcttatttaagtctctgcatctcattgtggcatccaaggtctttcataggatggccatgccttgtctattgatcttgcctctcctagtttccaacacacactctctgctccattccgagaaggctttttactgtcccttgtacatgttttctttgtacggtacagcatgatattaagagcacagagttttggggatcaagcagacctgggttttaggtctaccatttgcttagcaggatgaacttccatttcctcatctgcaaaatagggttaatatcacctacgctacaggaagctgtgaggagtaaacaaaatgatgaatctaatatgctgagcataggtttgataaataactattctctgtgcctttgttcatgtttttctttctgcctggaattatttgggcctccgcaaattctccccatgcttcaaggcctggcttaagtgtcaccttccttgaagaggcttttccagataattctggttcattcttgactttgcctctaaaagctataggttctatacctgttaccactgattttttttttattttgcattattctttgtttaattcagggatgcctctagcatgtgtgggggcacccaaacaagtattttttgtggggcctatctacgtacatggtttgtttcactgcgaatcagtactggcagcattttcgtggcacaatctcacgcgataccatgaaagaaataccacaccagccagctggagtggtttccttgccaggccactctcctggaaccaagactttggggaggattccatgagtcctgaagcttcttggggcatctagttcactgcacatacaggttagaggattggatagtatcgcaaaggggagaaatggggactcaggtacacatgtgtcctgtttaagattggggcttctcagatgataatgccagtcacagtcagtcccagacactggaggggaacttagaaaatttcaagaaaggtacttcttacaaccagaatacaaggaggagctgctctggacccaggacagctgccctgatgatactgcctgcctggccagtgcttggctctggaaggggacttagaaattatccaggtaggcattccaaagcacaggggtccctgaggaggagccccacttgcctggatctaaggctggtattgatttcattgtttaaatcttgcctctaggtcaaaatggaatttctgtgagagaagggagtgcactttacttctttgtttctctgcctcccacttctgccttcgctatagaacctgcagactgcaaagaaagaaagtggactgcaaagaaagaaagtactgcagcctgaggggttctggtaatgcagaggcagttgcagcagcagtagcaggacttactcccaaagacttcaccatgttcaccacacaggccagaagagcaatgcctgtacacatgtccttaaagtggccctgaagtcccctgggtggctctttgtctctaagatgctggatgaggtcaacctaaatggcaggaaaaacccaggattcccacagaagcagaacctcaggtctgacaggcacaataagagggagatctggagctgggcaggcagatggcacatggacatcccctgttacaaaggcagcccaagcaagctagggcactacccagcctctcacatgcctttttatcctgtgatgtcaagaccctgaaaatgtttgggaagaaaaaaattctcccaagaggaagttttatttttatgaaaatatttacttttagccctcaaatgtcatctcactcaacttgcatgtacacacacacacacacacacatacacacacgtactctccccttccctccctcccacccatggctctcatatctatactctactctcctccatatagtagttatgtgatgttgaagaaagtttcttaatatctgtgtgcctccatttcctttttggtaaaagtggggggttaatatctgtatgcctctatttcctttttggtaaaagtgggggtaaataatggcatttagctcaaaggacgaaagcacagaacagatatgaagacctctggcgtgagagatagtactgataggtaagtttccttccttccatttaaaatgtgaaaactcacactgataaattcactaattgaggcattcattcacacattcacaaacatctgtgataggcttcctatatgtcaggctctatgcaagtgttgggggtggtgtctaggtttcccgtttgatcttagagaacttaaggcttccgataccctgtcttcctatgctgtaaaataagagcactatggttaagaatgccatttatgtcttcggaaaatttgatttctcatgcagaagattttggagaaattattaacattatcttacccatttacaaactgttatttttcgttaggaaaagatcagattagattgtgtgccaacaaaacaatcccatctatttttcctcttctactgaaatgtttgtcttccttctattgttctgcctgcctccttgttattcgtatagctctgtcactcacaactctaccttaccacagattacagaaacatcagctcattaaacaagttctgccactttggctgagaaggaaatgtctgtctccatttactgtctactaataaatggagacaaacaaaaaacaaatatacaggataaatataactcctgactgatgtacttaccactctgctgtttcgtataattacattaatattttataaattcatttaaaagcaaacgtattcattgcatatggctaaagccagagtagataaactccccctcttccttttgttcaatatgccaggagttccataggctacactgcccataagggcttcctagagggcaggttgtacatgacatttcaaaggcttctatcacgttgattatttcttttgtttatctttaaccattaagcaccaaagtgaatgtggatttccaatgtcaaccaagaaaaccatttgaagtcatgggctttatacatatattgcagaacctgaaaaatcaaagaattccagcaatttaaaacacactgggaatagaacaccagaggaattatctcccttttccaggcccctggcctggcttgtggagtactaccaagtatgtaccattgccacttatattaggaattcaaagtttcaaagatttgaaatcatataaaagagttatggaaaaggccaagatactcctccaaagtccttttcgcaataaatatcctgttctattttgcttttatcgtctcttctaacaccatttccccactgccttcttgactcttggcatggccattgctgaaagagccatgacatgttgatttgtattatctctctctgttttttttttttttttttgagacggagtcccgctctgttgcccaggctggagtggagtggtgcgatctcagctcattgcaacctccgcctcccgggttcaagcaattctcctgcctcagcctccctagtagctgggattacaggcatgcgctaccatacccggctatttttttttttttttgtatttttactagagaagcggtttcaccatgttggtcaggctggtctcaaacttctgacctcaagtgatccacttgccttggcctcccaaagtgtggggattacagcatgagccaccaggcccagcccgtattccctcttctgattcatgtacttcccaaagtcccagcccactggaaattctgcaaatgctgtctgttagctggggccagcttgctcctcagacttgcaactctaccatgtgatttcaagtaatgtttccatgtagctttgagccttcctgatacctagcaacttgcacttactcaaccttggcagagtgattattgtccattctctgtacacatctgagccaaggaattacaatggaggcaaatgtcatttctgtgcagctacccagttatccctatatctattcattcaatattttgatgacaggtcctatgtcaggtgttggggctgcagaaatgaataagacaaaaatccttggccttatactctagtttggaaacaaccacgcaaacagttacaatgctgtaccatcagtgaaccaccataactgtttattaagtgcttaaaatgttttaggttcagtgctaagcattttatataatcacattctaatagacctgtgagcttggatattgttatccttcattttatggataaagaagttgaggttcaaggggggtttagttacgtgctcaagtttatacagccagtaagaggcagacctagaattcaaatccaacttggtctaattctaatgcccttaaccactacactgcctctcaatgtagtatgacaatggtttcaatgaattaatatgattgcagatataaagtgaagcaaatatgttggaaaaaataaggcatatgagcaacaaaatgtttacatacaattcttcttcccccaatatggtggattaaagttggatataaattctttgattctccttccatcaaggtaagggtctatgcccctatccctttgaatctggatgggctctagaactgctttaaccaacagaatatggcagaagggatactgtgccctttttcaggcccaggcattaagagagatgcaatttctaccttttgtctctagaaatgtgtgatacaggagcttttcatcctcatggaaggctgactaccctgctagagagaccatgtggagagagacttagagcaaatgacagaagatggatccagctgagcccagtcttgtatctgtccttaccaaggtgccatgcatatgagtgaagtcttgaaatcagcctgccacaactgaggtatcccagttgatatcatatagaacagaaaaattgcccatctcagtcctacccaaattcctcaaccagaaaaatcttaaaatataataaaatgattgtgttttaagtcactaacttctaaggtagtttgttatatagcaatagataaggagaatatccagcatggctgcagtggaatgtgattggttaatagagttaacaattttcaaggaatgaaaatagaaagtacactaaacagccaaactagactgaccatgatttttctcagatttttgaaaaggcgctttgggatcctgcagggcacagagccactgtcttgggcaactgatgccactacactgttgctatatggaaggaccattgttcagttggaacaatgtcagatgactgacgttctactaggtgtactaagataacagttgtctaccaaaccgtagaaacctcagaggtgttctacatctgatgtctgacaaagacatcacacgtgcctattttatggttcagtcctaatagtttttggcaggcccgttcatgctggcttttcttttctttttttttttttttttttgagatggagtctcgctcttatcatccaagctggagggcaatggcatgatctcagctcactgcaacctctgcctcccgggttcaagcgattctcctgcctcagcctccctagtagctgggattacaagcacgcgccaatatgcccagctaatttttgtatttttagtagagatggggttttaccatgttggccaggctggtctcgaactcctgatctcaggctatcttcttgctgtaaaatgccaacttttacctttgtggtaggggagaggaatactagccactcattaattggctacttatgaatttccaggttttatacactgcatctgacttaatcttcacaacaatcctaagggatgggaaataatattccctattttacagatgaggaaactgaagctgaaagagataacacagtaaggatacacagtaagtagctcttactaaacgtgctcctaaccattagtctacactgcttcccacaaagtccacagtttcatagagaaagacagatgccctttgtcagatcagtatctacctactcaaccttgtacgtggccttcaaaccttcctatccaggaggctatcctggggttgcttatctctaaacccagaagttcctattgagatatttcacacatgcattgtcacagtgttttggggcctctttttaaaattcattgttgcaattttgtgccacaaaagaagttgaaattgtggccatgtatcaattggaggcaggcaaaggtaggaagtgacacacattgactatcttgcttacaattttcagaactggaccctggttcttactggaagcccctttacactctcagaaaggctttgcctgcacttaacgacttatccccatccaagctcccctggcccaataaaagcatttccaatcttttaggtgttccagagacccctgagccccaggaggtagtttttactcacagtaaaaccactgaaatgcaaccacagattattccaaaataactatttcaaataggatctaattatatatgcataattaagctattttatagaaagttatgatttcaattgagctacatatttctgagacattattgttatttctttacagttcctacaaaattcattggaaaattaagaattatgcctgtgtactgggaaattttaacccattacagtcctgcctcctttctacatagtttctttaaaagactttttaggcagtctttgtcagattaatatctacctactcaaccttatatctctcttctaatctgaagagagaacacagatttccaaggacagcctggctgagctgtaagatgattctggacttctcaccagccctcttggaggcacaagttcccaaatttttttacaatgactctcaaattctacctacatctgtcccgtttccccaaaagatcatctaaacacttgtttcagctcagctggaaaggtgagacagggcctggctcatgtacaacagcaaacaatctggcaaactgggattggtgggttatgtggcacaatttcagttcacaaaggtcctcccaaacatatctcaactttgatcccaaatttccaccagtggagctttattcctttagtgcaaagttttgcaaaatctccctctgtagcccatcttccctcaactcctttttattcatttacactgtgttcttgcctttttagaacatttgacaggtccagagtcatgccctccaaaggtattcacctttggaggggcattagtgaggacatttcccactacatctgtggttcccagatttctggattttggaaatgaataaaattatacccatatttaaggtcaccagcctcttaatttgacaagaaaataagtggggaaaaaataaaaagaaactaaaagaagattttaaaataaaaaatataggaagtctatcacctcagaataaagggcagtcctttcaattgagcaaatttagcttcatgacaaatttactgcatttttagtttttacattttgccataaacgggtcctggcctacacaccagtgtttgggcttttgagatcactcaaccatttcacttagtgtgctcccctatatatgaaacttcctgtgaaaaatttctttcagaactagaatgtcacacacacacacacattattaagggccattaaaagcttcacttcccctgaggactggtatattttttcttcatggaaaatgcaaattatataactgatcaggtttcccttttttgttttggctgctttgtcacaggggcagctcaacttcagaaatcaggtgggaatcctatgacctacacacctgaattttaattaacttccctacctggtctttgtcttctattctcatttatattttcccagatgctgatttattttatttttttataaattattgtattttttcatatactgtaatctttcttataagctgcctcaaagtctttgctgaatgaggtgatgtaactcaatagttaaccactgtctccatactgtatacccttgcataccttccaatcattgatgcactgtttcctctgcctacactgttcttagttctttcatcctcctgacatactcctatatatacctggacacctagctcaaacattacctcttttgtgaaccttctctgaccactgccatctacctagcatttcccctcaccacacctgggctaaaacaatacttatgtacaagtttctattatgacacttgcaacatgatagtgtagtggtatttactttgttgcttctgccactgcaacttgagcttgaaggcaaggattgtgccatgcccatattggaatcccctatatctagctcaatagattttcaatgaatggatggataaataacagaacaaatgaacaaaatgaaaggaaggcctttgagctgttgtcagtgaacagccagctcatattcgagaacatgttggattagggagagaatgggaaagttctaaaagtattggagtcactatgagggtaggaaactttgtctttcttgttcattgctctgtccgcggggcttctcacagtaccttcataccggcaggcttcagtgaatatttcttgtatgaatgaatgaataagcaaatagtttgactcagttctttctcctaatagtttccatggggagtcttttccttttctttttaaatgatttttcctatcactgtgcatttacttattccagctagttaacgtcatgaaattcttatctcaaagatcctctagcccttgagcttcatgtactcttccaaaggctttaaatagtttaaaatgtttccaagagaaaacagctccacagcatttacctacacagactgtgatgtcgagcgcctcactatctgtatttcttggtgtcttccttgggagataggacctcgttctttgtggggacctcaatacacagtctctattatgttgaccagctcctgtttgtccttctgtggcccagttaatcttgttgttgccagtaatcaagtcaaaatcatgatgtgcttgttcccaaataaaaatatgacaatacatagatcatataaactcatacatttttgttgaagtaaagtacttctgtaatatcaagataaataactacaacatttttaaccttttcagctatacaatacagaactcatgcatattcataaaagtagggtcccaattatgtccaaaccaaatgatgacgcctcggtctttttttttttaaaggatgacctgacacaacagctaactgccagctgttgtgttagtacaggagcgtggtggcatggaggagacttaaatgagtatctccaggtgtagatatgttccatggtgaatcttgagagtaccatcagtaggtagaattcaggtttgttttgaagagacattaattttatctggtatatataatgtttacgtattattggctcttggtaaaatatataccatgatgatgaacagtgctctcctttctcaggattgcaacttttttgccactaaaagcatactctatttgtggcagatattaaaaataatacaaaccgaagtccaggccttcctgaggagcttgcagaacagtggtctgtcatgtatcatacaaactccttctttctttctgttcccatcagagttggtctgttggatccagtgagaactgcctccttaagaatgagcagggctttgctctggaaataaggtccatgagtccatattttccaatatctttcattatggagcagacacagtcaatacagtggggacatcataatgagggactcttctctttttggacttcacaggctccacacttggctgctaaggatattttaattgaggggaaaataaaggaagcagcaggtagtattcagcaagtatcccttaatgggtccatccttggattcatctggaatgactggggcagaacaatgttctttaaccagagggcctgactctattgggttccactaacattagtcttatttgaccagcttctcaaagcaaatactcttgcaggaaagacagctgccagccagaggggacctcctgatctgccatcattatggattaactttattgaaccacagctgtacaaaacaccatgttagttgaaagggaactccacaccaaacctcagagatagcctgtttctactccctactcaatgaatataataattatgccagacattgccttcatgacaagtgtgtgtccaagagactcagcatccatgacagtatagattagaggtctctgggggaagtgaaggaagcttacattattgttagtttttcatcaatgtcaaaagacttttctattgtcacagacaggccagatgagacaggacaaagaaaagtcttctggctcagtaggaaacctcctgagaagcataaaagtagctgaattactgagcctttgatgggtgacttcaggcaacagctccatgaggcttatttgctgccttttccattttaagaaatcttgaggcatggggtgctgatcagggagatgttttaacccattgtaaagatggcaggcactctgttctccagaccttggcaagaagaaaggtagggagcattggagtgtcgtgccaaccttccatttctgtgaaaatctccaccagatttataaggaacaggcatcagcactgtcagacatatactgttctcttcacctgttgctgtccagtatttcaccaggcaaaaatttcacgcttgcatttgctgtccttcactattgttaaaggtaaagatgagtcataattcaactttttgtgagccacatcgcacatgtgaacttgaaacactaataacaatagctgagttaattgaggaattactgtgagccaggcatcattctaaggctttacatgtattaacacatgaatcctcataacaaccctacaacataggtgccgttattatctgcattttacagatgaagaaactgaggcatagagaagtgaagtaacttgtcaacggtcacacaactagttaatgacagagatttgaacataggcattctggatctagaacccaagttcaaatgtcaatggtaaactgccttcctaaaataatacagagatgagaaaaaaccagttcacacataacttaagtgattttatacatagctttacaaagtatatctcagcctgatgttattgccccatgcactttaagacaagaagggaactatttaactaataccagcatttccatgaccaggtttctaaagagtcaattaactttccctggagcatggtggcagcagaatcactgaattacatacaggtcaaagagaaaccatttctttacagtcgttaagaaaacaagatgtggagaagggggccaatggtagaaattaaaaatactcttgaggtttcaaacgtctggttgaagctggatgtgcagaacgctcattagcatattagcattgacagtggctccatagcatccaaatactttcaatttaagtgggagcttagcagcaatttgaagaatgtatgttagtacttcctctacatcaaagagcatatagtactgctaagagtagtaataatgatgacagtttatctttattgggtgcttattatatggtaagcagtgtgctaagtatattatttaatgtccacagtaatcctgtgagctaggacactatcattatctccattttacagatgagaaaactgaggaacagagaggtcaagtaacttgcttaagggtaacacagtaagtggcagagcaaggactcaaacccatgtaatcccctgacttcaaggcttgtgttgttaagcactaagcaagatactgttatgaggattcaagccctccaccacactgtttagaaaacttaccccaatcttctagccttattattgaccccagctcaagctttgggtctgtaatgattgcttggtggcatttttgttctcaatgctaggcctttcttttccatgttatagatggatggctaagtattgaatattactttgtgagcatagatttatgcttatatacgataacttacaaatcatatgatatcagttaacatttagtcccctggaacacagcgcagatgtggcctcaatatttttcctgggacttttacacatatggtccagactgtcataaactggaaatatttaagtcaaattagattgtctagtcatcttagactataagtgttgtgactcagggacactccacaatatatatttcagtttaaaacaatataaaacaatatatatttcatataaatatataaaacaatatatatttcagtttaaattctattataatcaaataataaagaggtactaaataaaaaactcgttacttccttagaaatgtctatgagaaatacattagtaatgatttttgaagtattttaatagctgccatttttgagtaccttctatgtaccagacattgtgctaagtatgatttaattgtcataacaatcctaggagttaggtactattagtctgactttgtagatgaggacactgggtctcagaagatacacaactgctcgagatccaatagtgaaagaaacaggcttggaagccaagcagactgaatccagaacctgacctcttaaccactctgcaatactggctcctacagtaacattcactgatcccagattggccctaccagtcattcaaaacttaaggagatccatggtccaatcacggtagctctcaaaggatgtttggttgttcatttcaattgttgttgttctaatggagaagaatacagtccagtgaactacaacctatggtatgaattatagtagtttggcagagttctttgcacctgccatatatagaatttagactccttttttttctccacccatttcttattcacatacctttttttcttcatgtttggttgcttttatgcttgtttcttggcttttgatgtaataacatttcttaattcattattagtattgctgtctagtggacctcaccctcattataacttataaggatttaaaacctaggctggaattgtgaaataatatttttgggggtgtagctaactatataaataaatggcaagacaaaatggcattactctaaatctgtttctcaaatttagtgtgcctgcgaagcacctggggaccttgcgaaaatgcagcttctgattcagtaggtctgtgctggggcctgagattctgggattctaagtggttcccaggttatgcagggcacactttgagtagcaaggttctagattggcctggtcctgttgtgcttttaagtaaagtcacaattaattgaatctggggagattaatgtttaggctgtttaaaaagctgcctcaggctccctgagatggcaattctcaaatgtcttcaaaaatttattgtaataattaattagctctcactgtccaggaagcttttttgtgtctaaacaaaaccctccaggtgctgtgatgttctgcttctcattttatcttcagcggagatggagttagtccaccatgtcaattctattatgggttactttgtttatgtatatatgtatgtgtgtgtgtatttacacacagttcttcaatgttaaaaagagtctttgggctgtcctccaccgtctcctttcctctcctctaggaatcttaagatcttggagatatctaagtcagttctcttcctgtctccatgtttatttgcctcctctatgaaatctataaaattacacacgctttgtaattccttgccaaaatcctgttgccttgtatttcaaagagctgtttaaagcttcaatgaccctagcctgcattggatatacacccagcatgtccaaagtgcaaaacggagtatactagtaactactggccacccagactataaagctcatattacaaaaatgcacactctaggcagaatctggtaaatgtcaacttcaaaataagttgtgtcatactgctatatttataaccacatggtcaataaaaataagcacttgcgaggtgattaaaaataacataccaggtaaaattggttgtccggcaattcccagcggtgccattccaagattattcattgctgtggcccatgcagttggatcagacataggtagtgtcattgcagtggaatccacgttcagagttctactgttatcggctgaaaagaaatgacaagcaaaataatttgttgtgttaaggttctagcaactagtttacttataaacataaattctggcaaactgtttatagaaatggctggagaaatggacaagtggtggataaggcctcaatgccagctttcttataagggttaaaacaacacagcttgaactggcaggaagtcatggaatttgaaagtaatttaccagatggcattttagtataagtgtttccttccttctctccctttcttccttctctctctctctctctctctctcttttttcaagcatacacaacagaggagcttggaatgattaagaagttttctattcttctcacagtctactagcatatgattacttcagcagcttccatccaaactacttatgcatgtaaagcaagaaaaaacatcctagggcttctgtagttggcaataaaagatgaaaattatactcctgatgtaatttcatatctttgaagcagtactattgaatagagctggacacacaatcagcagacatcaaattagctgaatgacaattttgggggttaggggaacaatgagaaaaagcagactagagacacagtccctgccctcaaaggttgtacaataaaattgaagagactgatgatgatggtgataattattaccattatcactgttatcaccacctccacccactactacctctgttgaacacttactgtatgccaggtaaatcacttggcatgcatcattctcatttaactttcagaacagccctatgaggtagggactatttatatctccatttaatagaagttttagagacatttaagagaagtttcgaaaggtcaaatatattgtccaaggtcatacagaatgtataatttttagccactatgctttactatctccagttaaacaactaggaaacaatgaaagactcaaatggtatagatcagaaatgttactgtagtttatggtatgcagagctactgtggcctgagtaagcaggaaatacttcatggagaaaataggacttgaaagaatggaccagatttatatagagcatgtcatgagtgatgagcagttattagataggtaaagtagaggggccagacatcccaggagcaggaatgatataagcaaaaacattgaaacgggttttataagcacgtacatgtacacagtgttgggagagatatagtcatgagtcatctgagcacaaacagactttcgttttgggaaattttcctctgactactgatagccatagaaaaatctttctatggcttttttcctacctcccagtacacacttctgccaattacaacccatgaaggcaactctgttctaatagtagcttgctaaagtccaaggcaacatcagggctgactcttgccagggttatgtatacatgtgctattttggtcactgattggtcagaacaagcaaatgtaaatgtctaaaaacattatttctgaaatattagtttttgtcatttttctgtgctgcctttgcctcttcccccttaatccctccttcacacacacacagtgattgatggcactaagtgttcattaattacagtcagaagtcacatttcagagtgattactcctacagagtgatttctccatctgtaggaactttagtagttatatccagctttcagtgttctctcacaaaggcatatccaaaggctagaaatagcctccttgcaaatattatcaagaaaacaaatatgggatgctgaatatcctttgggttgagagtttacatagtgataattagtctacttggacttccaagcccccagctaggggaggtaagtttttagagaatgttacagctgaaagatacctttagagattattgagtctacactctgattttctctggttgctggagaatcagtcccagaagaaactggtaggtttagaaggactgggacccaatgccaaaaataatttcttacaacagtttggctactcattggttctgcagtcatgagaaatattaaaacaaacaaacaaacaaacaggaacacttctcagtaaaggattttgaggtcaaagaatgagaatttataatatattaacctagccaaactctggactaattaggggcgggataagtgtttgggggaagacaatgatctcaattacaattttgaaggaaaacacagtattgttattttcaaaatgtatagtaattcacaatgcttgttaacatgttagtaagtagagttcctggtatgcttgtttacaggaacagataaggaacatgtgtgattaacaacattatttcatctcaatgaaagtggttcttaaattcttaggaagttttgctttaaatgtccttcttatctcccttccctcccctaacacccatctccacctgtcaaaatcccactcatttttgaagggtcacctcaaatgctaccttgtttatgaaactgaaatggccaggtgggaagggctccctggcagagcctcccactgacctgcaccctggggtggagccttggaagttcatgtgtttgcagtgggaaggagcctggcccctcctcttcctgggtggaacctgggattcaatctatgaggcgggaagcacaccagcaggactctggccttgcagagggtccccgtttcccttttttacccctttttctccaatacattccatttttctcacccttcaaagtgtctgcaagcctaatctctcatggccgtgtgacaagaacctggttctttgctgaactaaggaaaaagtcctataacaaaaccacctcattggaattaattacttcttctgatgtgttctcataacattttatctagaatttgattttcacatgtttgctcattctctcactcattccttgcaaactaaacttttttgagtcttactatatgccatgctgttttgctagtaactacgaacacagagatgaacaaaactcatttactgctctggaagaattcaaaaacaataaacaatccaatgtaaattattataataagtactgtaattaaaccatgagtggagtgctctgggaacacagaggagtaattaaagctgctgcaatgggtttgggtatacgtgtttctggttgtggggtggaggaggaatgccagggaagccttcattgggaaagaatcatttgaagtaagtctttaaggagggataggattttcttccaggtagtgaatggaagattggggtaagaagagcattctaaaaagcaagaagcaccaagcatttaccaccgactgccttggattattgttattgtgtacatgtctcccttctgctggcctgcatgcctcttttaggtcaggtactgggtttgaggcattttctttccttatttcttagtttagtgtctagtataaagtaggtattcaagaaatatttaaattaataaagaaaattaatttacattgattttgggcacaataagcagtctatacaatgacacccattgattatttgtataccttttcagaatgacaaattgtcttaaagaggtggcattattgctaagccaattctttctctaggacagctgaatacttgtagaaatttgcttagttacaaccagggatatatgcccaactaataactcagtttgatctcattagctatgatctttttcccatatcggcataatcatacataaaagcttgcaaaattttgctttcaaaggaaaatcccagatgatcacctctggcagtaatctggattcaaggtccacggtaacaaaacatgttgtgctaagtatctgtttagaattatcacttaatggtggaaaagttaagttctggcctgatccactttctagactagaaatggacatctagtaattttcccctgaatcctacaatcactggcagcagccaagaatattcagaaggcgaatgctactggttgtcaagtggtctttaaaatacctaccccaagtctgaagaacatgtcttgccatgctggttctcctattctgctgtgtgacaagttctcaagaggtcagagattgtagagtggctgtgagtaagtgccttctaggtaatttggttgaagatatggcactttggaataagctccattagcaccaaaagaatacaagatttggaagtgatcatctacttgaacttggtatcattttataactatcaaatctctgccatctgtttatttttgtattgttgatgcatcactaattaacttgtcaatcactgtcaaagttatttgattttgaagactacacacacacacacacacacacacacacacacacagacacacacacaatttcctctgaaacaaggacaacagtatgttggtgctgtctcttcaactatattctttcattaagacaaaaactctccttctctgatgatttactctcctacaattctctttcttatgtccgagtggatatccactggtttttatgctcactgtaattttgttacacattattatgcaaagttgaggagacagttttgtcaacaaacatctattgaaagcctgttaaccacaggaagcaatcctgtctaatcatcaagagcattggtctgggagtcagatggctctggactagagtctaactctactacttagcaactgtaatgtgctcattcactttctttcttctcttcttgcctgcctgccttccagtcttcctttcatatttaccatacattcactgaacattatctatgtgtcaggcagtattgcagatgttgaggatattagggtgagtcaaagagacctcatccttgctcttgtagaacttatactctaatgcaatagacagatattaaaatacaaataattatgcactgtaataagtgttatgagcaaataactgggtttgacgaaaaaatgggaagctactaaattaggaaaatgaaagcatctaccttataggtttgttgaagattagataatgtgggtaaagaatttagcatgtcttctggctcatattgagcgctcaataaatggccataataacatggtaatagttatggtaaacgatgaggaagtggtcccagccctcggggggttcaaagtctactgagagaaccaagcatacacatgaattactagaatacactgtatgaataatgaaactgaggcacagagagtttaagtgatcagctcaacatcacacagctagtaggtagtagagcaagaatataagcccagtcagctctgatgccaatgctcacaatgtaactcatcacactaaactctcttccaaagagtacatttattctgtgttctcttagctcactgaagacattgctatcatagcccttactacattatatttttctgatctttttccatgtctgtctctccccagaaattgcttattcctccttgttatttctagtgcctagacacagtgtctgacatagaaaagatgtttaacaagctattttaaacaaatacatgaggaaatatatgagtatacaaaagagtcctccacagatattctttccagaagcaggtgtcaagctattcagaacaggatactactctattattgtattaagataaaatctcttttggagggtttcttttgagggctgagtgttaaacaaaaattttaaatggaaaaagaaaggaagataaaatgatgacaatttgaagtattataatccttacatgctgataatacaaaaaattcccaattacagacatacaaacttcaaggaagataaatctggggatgagaagatagcatcactgagaaattcttcacttatgagaaggaactaaaatttcttagagaatttaaggtaattaaatttactaaaatgaaagtccatgtagcagccatatttgttaattccttgaggccaggcgacacaaacctcatttacttctgcaccctttactgtgactagctcaaagtaggtgccaataagtgtgtttttaaataagagaactctacaagaactcagcaactgtacaaagtggggcttacctgcatagcctatttcgtagacccacagccatctaaaatctctttgcattgtgtggtcctcaactgtgaacttagctctgtcatcatttctgcagaaagaagatagtagtctcagctgggcgtggtagctcatgcttgtaaatcccagcactttgggaggcggaggtgggtggatcatttgaggtcaggagttcaagaccagccaggtcaacatggtaaaacccaacgtctactaaaaatataaaaattagctaggcgtggtggtgtatgcctgtagtcccagctacttgggaggctgaggcacgagaatcacttgaacccagggatggaagttgcagtgagccgagatcacaccactacattccagcctgggcaacagagtgagactctgtctcaaaaaaaaaaaaaaaaaagaaaagaaaagaaaaagaaaaaagaaaaagaaacagatagtggtctaaaggtgggtgggacatgggacatcaggcctctagaatatactaggactcagaaaaatgatgaataatagttttttttttaatactttaagttctgggatacatgtgcgaatgtgcaggtttgttacataggtatacacgtgccatggtagtttgctgcacccatcaagccatcatctacattaggtatttctcctaatgctatccctctcctagccccccaccccctgacaggccctggtgtgtgatgttcccctccctgtgtccatgtgttctcattgttcaactcccacttatgagtgagaacatatggtatttggttttcttaatagttttaaagatagcaattataataagactaataagagtcaacagttatataatgcttactatgcacctcacactgttctaggcactttatgtatattaatttaaaattcacaacaatcctatgaagtaggtcctttcattatccccattttactgatgaggtaataggaacagagaagttaagcaagctatccatagttatatagctagcttgcagtagagccgagattcaaacccaggcagtctggcttcaaaattcatgctcttgaccactatgccctactaaactagggggttcatcaagttatagaatatttgagctgagggctctagagctcatcattatacagatgggtactctcaatgtcctctattgcagtgccaagtttgccccacaggggacatttggcagtatctggagacatttttgattgtcatacctggcagcaggtagttgctactgacatctagtagaggccaggggttctgctaaacatcctacaatgtacaggacatcccccttcaagaaccaattatctggcctaaaatgtcaatagtgctgaggttgagaaatcctgctctactgtaacaatttttgtgtgttcttactggagaacgccttatacccctggtttcttccataatcctttcccatctatcacatgtataggcaactccaacttctgtagtttatgccgtaccctactctcttatgctatcgtgcaactaagactaatctgatcaaaccctcctctctgaccccatctcaagaatctattaacgctttcagcatggttacttctatgcttcacatcaaagaaatgatccttgttgtgggaagtccaggtaccatggaatgctcatgggttgctgtttgagaatagtcctggaaatagcagtaggcacaccatgacaaaggaaagagaaaggaagtttagaaaatgcttgaacaaaacgtggaagaaaacttcatttctggcatatcacataggacctcgcatatagtaggcattcgagaagtatttgttgtgaaaagatgacacaggggcagggttgggtgtcctaccaaggaataacattgtgttttctgttctctgtctaagggaaaggaaacagtagaacaaatcacatttggggtctgcattaagcctggggctcaaggctttatcttttgcgtagtatttattgcttatgaagcaatatattgtggcagtgcaggtgttattttgaatctctcttcatattccttgaaaattaacaatctatcattgtttgtgaacaatgcactgaagcctgaggcacaggccacagtccctcctattgcagacttcaagtgatgccacagcttgcatcacggtgatgcaggtgagagaactgacaggggcttttgtaggcttttgtaatacaaggctcccagatggcttgagagagatgatgctattagacaagcaggatggatcaaagagtcactcaagggaatcaagatgtcatacattctcttccttgagaaaggaaaaggagataagggaagggaaggcaaagggaggcaagggaagggtctttatgctggcctatatatatagtaggtagtcattttcacatgagttgtgagtgtggcagggtgggagttggaagagaatagcttgatcttcaaggtatacagatgagaatctcagcatagcgggtgctttcacaaactaaacctcatcctggaagatttattgttttagtctataagctagagggtcctgaagacagccacctctgtattggagcagttatcaagatgttcaatatttaagttagatcaatttaaagccacagagccaggccagccctccagatggcaattgtagtgagggtggggtgagggcgtggtatagtgaggaagaagaaggccacagaatttggtatgtgcctctccaaggaagtgatagcacataccctacatttatgaaggcaacaaggtataatagaaggaatacaggacttggagccagatagatctaaaatccaaccttggctgtactcctgactagctgaatgactttaggcaagttccacaaactttttaacctgtttattcacttgcagctggggataatgatacctatctttcatataaaagataatgataatgatgttgattcctaatattggttaaatgcttattatgtgctaaacattgttttaaagctttgcatgtattattacagtaagtagctagccaggcatgagtggggcaggagagggctcccccagccccaccaggaatgtcaggcgactatcaggtagttgtcacactgactctctaaaatagtaattgatcatagccagcgccaggaaaaagtagtttcccaataaataaaaacacctgaaactggtgattggcagcatcccaataagatctctggtattgggcaagtgggctcaggcatgtgcattaagagacaaaatggcacagttgaactgatatatgaccttccaggggcattccactggaacagggaagaacgcttcagatgagcatgtgtacaactctagtaaacacactgagcatgctcacctcccaagtgctagcaggcccccacacatgcaggcagcttaccctaatggaagaatcaagggaaacgggatgcaagatgctggaagtatgccagcatataaaaccctaggtccaaagtcaaacagggcacttgacctccaagatatccacttagacctcttccaagtgtactttaccctcttttcattcctgctctaaagctttttaataaactttcactactactaaaacttgccttggtctctccttcttccttatgcccctcagtcgaattctttcttctgaggaggcaagaactgaggttgctgcagacctgtatggatttgccacaggtaactcagatacttccaccactaacagtattatacaatataattcttacaaaaactctatgagacaagtgatatttatcattatactcattttatagacaaggagtatgaaacacaaagaagttaacaagtggcttaaggccacagatacagttaatgttggaattggaattcaaattcaggaagtatggctccagagacaacacgtttaaccactgggctatataccatcactaagaatgctgagcccaatatctgacacagagcaagtacctgatcatgactttaaccctacttcctttatctttcccttccctttttctggcaaggaagaaatcattcagatgccctgtggggatctttgagctgcggccaagggcttcttttgtaatttcagggtgggctggcatgggctgaggtatctcagggatagtacttttcagttccaggttattaggcaaattgagtcagaagaataggttaaggttggacccaggggttctggttggacccagggttctggaataccatcaggctccactgtgggaaccttagagggctgcctcagctactaagagcagtggctgactccccttgagaggctcttttggggtttttctggactacagtctgtaattgccaaccctctggcttcatggacttctcagatacctgtgaactaatgttaccttggtctagagtgaatggctgactatggtcctctaatctaggattacatcatcacatttattccatattttcttacctaatatttaggtaaagaacaccaaaaagcatagatgggcctaaaaaaaaaatgctacctgtctcagctcctttaatatctgcactaattgcctgttaagtcatataattcttttcctggttttgaaataaacacataaatattactgtcaggaccccaaatgttgtagttactggtgttcaactagaaatcttaatatttaaactaatcaactaactgcatttcaggtactgagcacgctctttaagttaatggcatagctgctggtgggggagggggtggagaaagaaaaaaacagaagcataaactttgttaagttcccaaagctctgtggtctgtgctttcccaaggtaagttgagtaaaaggtgacttggcaacactgctaccatgctcttggaagtctggcaagatctcttggaggaaaaaaaaccccacatcagtcctggggctaatccacaagccgttttgctgcagtccttgttgctgaaaatctttccaatatgtttcagtccacttccttgccatagaaaatagagtatgacaaggataaatatagcatgaacaagatctggagtttggaaggctagtttgaactctggccctaccgtttactcaccatgtagcaatcacttacacctgtgtttgtcaaagtacgttccaaccatgtgcatcagaatcaccttgggtgcttgctaaataggccaatttccagggttcactgctaaagttttcacctgggtggcactggggactctgcctgttgaacaagtaccctaggtaactcttacacccactacaaatttgagaaacacagagcttcagttttcttatttataaataagaatgatgccaccctttcacagggtggtggtgaaaacaacataggtaatcaatatgtgctagttgtacctgaatctttggtgaagttattgcaagactacgagatacattctgaatattaatttaacaaacttgtgaaagccatatattatgtgatggtacccaggtgaaaactacatgttttcctgtcctttgaggggctcatagactagtgagagtggcagatatgaaaacaaaaactactgtacggtttgaaaatggctaaacagagatatgaagaagggggagacagttcccctgctaggacggtgctaaggagagaaggtggtggaggagggaggggagcactgaggaagtgatgtgaagctggaggtagtgactttaaactgagttttgaaaactaagccaattatcatggtactacaaatatcttaaaaggtacagaacaaggctgtatttgtactaagtctaaaacctagaatgcaagttgttcttgtttggggaaatgggagtgagtggagaatattttccatatcaatttccttatcatttctctctcctaaaagtagaatgtggaacaactggagtcattttgtattcccagtaggttgactctgagaggatgggtgttgggctatattgttgacttgctgtgtaagtcattaactacatggccatggtctaagttggtgggggtagggggtgggaccctggccatgatgactataaataagtcaggtggtaaatcctgctaataatgggacctttggctgaagtactagctgcctcagcagggccatcctcagatattaagggcaatgctatatatacacatacaaccgcatgaggcagtgactaatggctctgccttgggccagcagctctggcccctttcgtgcttctttacctctgcaaagcagccaaactggagttttcaaactccactccaatttgacaaataatcaaaagacaatagactttattatacataccttcacattatcttcactacccttcatgtttcaaaatgactgtttttttttttttgaaaaccacaacacattcccatcaaccactagcatgcatttggccagaccaggcatgataaactctcaagccttaatgctgaacgatgctgaatgaagagaaaaacaagtagggttataacagtggttaagatcataatctttggattagatctgagttctagtcctggcccaacatttattacctgtgtgatgttaggcaagtgatttcatgtctctgtgcttcattttctacatctgagaaatgggataataatagtacccatcttatagagctatagtgaagattaaaggagaaaatatacaaaacagatctattgtggtgcctaacttagtaaatgcttgtagaatactagtaattattatcaatatactaacaatggtgggcattacctctgatatcttatggaaaacaggggccactgggggtaaggaaagaggggagtgttacaatttcttcaggtgaaaagaacatgaaaataccagtacaggaaccagccattaataatattagattggtgcaaaagtaattatggttttgtgattaaaagtcatggcaaaaatggcaattacttttgcaccaacctaataggagagaatgtatttacaacaaaaaaaggacaagatggtttatctttaacaagttctttaccaagaacactgccagaaaaaaacagtgggattaatttgtattcttctcatctgattaatgcattttctgaaagtgctactgctaataaaatcctaaaaagatgttccagtgttaccctccaccactgtacatacccccaacctatcagacctgctgccaaaacctatttgcttttttcctctaaaaccatggatgacatttgtatctgtgctctctctcctgatccccccatctgtggtggaggaaagccagaattacttagtgttgtagctcaattatccatgacaagattggaaagcaagggggtaggcaggagaagaacctgctcttcacagacagctttctaacaagacaaaggcagattatggccacggctgtgacctccatgacagctgggcacaggacacccgctgtatcggcatactccaggaacaatacacatgcaagtaaatttggttggcagtttgtgattctgggacagtattaataatagtgcctttcctgaaatctatcctgtatatgatatattttgccacgtttaattcaatagctcttctgaatattttaatacagcaacagtagtccaaatagcaaacacatgtgagttattaactttcttttatccatttctgctgtaacttaaattttcttcctgagtgaatctccaggccactagtgacatcacctttaatctatttgtgtggtgtgtgtgtgtgtttattggcattaacatggaggagacataagctgttaaaaaataaaaggcgtctaggctagtgatgatctccagagtaaaccttacagggattggcagagcaaatttgatttgaaaatgattacaaagggtgaattccctgtaaataatgaattggaaagaaaatcaggctgggagtatttgcttatccacttatttccacatggaagaaaagctgtaattcctgacagcctgtgcttacagtgtgactagattggccagagagaaaccaacgggtgataaaaataagtacacaaccccaccagttcattgcattctctgtcagttccaacaccaaggaaaaccataaagataataagtctttggataacagcccataaatccatggttacagttcaagcacttaacttcaaattcccaagtgaccatgccactgttcttatctgttaaagaagctagaagttcactgtcagaaaggaggtgaggtgatgggcaaggcagctgaaatactcaaagaccccagcaaaattctgggaaagcatgccctccttgcaaatcaccacttcttgagaaactaactcatatgtcactgggagacactgtcagagccaactggctaggtttctaccaaagtgcacctagttttcaagagtggctatcttccttgaaaatgtaaagctaatttctgtatatcaaatcctatttttttccactgactcacagtgtctttttctaatttttaaaattacatattgagtaggtacacaggaaaatttataagatacaagcgtaaagtataaacaacaacaatgcaatgaaatttgtatgcccaacatgcagtttaagaaaaagaatatcactattacctttaaagtccaccatgtacccctccctaatcgcttccatctcccctgaaagataaccaccgttttcaattttgtgttaataattccttgcttatctttataattctactacatatgttgataccgtctcttcaaaaatgttttatcttaatttctaaaggattctttaattgccaagagctttctgtgctgttttctttcatactcctgccccaccgtttccctctccctcccctccctctcttcctccttctctctctctttctctatctaccttcctttctgtgtctccctcaccacccctcctccactcagctagaggagtagttagtgatctaggaacaaacatgaatgccaaagatatcagttagcagtgaatccgtatgtaaaggcagtaattattttgtaacatggtgactttccttttgttctttaaatgaatccctgcatgggccctaattcgtttacccagaagttcagaggtgattagggaatatggaggtggcagcaggctacagagcagggtgacggagctgtgagtattgcctagcatgggtacctcaggggtctggagccagaagaccatgctatttgctggctatgtaacttaggcgagtcacttaatatttctgggcctgggttccttcatcacaaaaaatgtagaaaacagtaatactgatcttacagggttgatgagataaacaagggatattaattggaaaagtattttgaaagctataaaatactatataaaggtgagtaaacgatgttgctgttctgctgctgttgatgacatcagttctattaaagtcaaggtaaacaactaaatggttatgaattttctaagtttggagctaatccacagatttatccttgccagctgcctggtaaagccagcatatcacagataaaattaaaccttcttttccgatgctttattactggtccatgtggaagcttccccccgcatcccccgacttcaaacatcttccccaaatcccactgtacctgcccaatctgcatgtgagggagttgtgtttgctctggtctacgtcagtgccggagcccagggcagaaagtagtcacacattataggaatgcaacattttctcttcctaatcatttctcataggacagtgcaggttggtaactcaaatcgaaatgtatgcaagatgtgctcatcacctgatcagtttgcgcctgaggaaccttctgaaggtcctgacttttgcctgtgtgctattaacataaccatttgcatgtcatttccattctgttttttaaagggtctctccttgaagatctatgagaatgagagtaagcagtggacagccacgtttccattctgcaaacgatataaccaaatctgtaaatgcgcaaaaatacacacaagagacgctccataaagctgctggcaattattttggtgaacagacgcaagttgtgcacaattccccacagctgcctcaggtgttgaaggaagagattcaaacaacagagggggaaatattgatcatctttttgaatatagagttaggctacctgcttaggtgcccaggagggggtgtgagagaaagaatgctggtaatgttcccacacgtttcccagcttgaggctggacagccacatgcccatctgctgctaagaaaaaaaaaaaaaaaaaaaccagacagggcttaaacacatacgaaaggctgtttgacctttcaggttgtaaggctcttgccctccgcctaacagctgacgcctggaacaagcaggcaaaccccacatggcctctgaaggggctagcatgggggctccagctgaggggcggctgcagctatggcaacacatgcctgggaatgagttaacaccagccaaaggggttaatggaagaggcaagagcttttatacaaatgcattagggaaagaaatgcaatacagtgggaatgaggtccattaataaagctgagtgataaaatccacgaccattctcaaattggacttggcaacttaaactccttttccaaattagggtcctgtgttctagctgctcatggggatactaagcttctatctttaaaaagaataaaaacaatactataatatgcagttaaaaggagaaaataggataggcaaaagggtaaaaattagacttgcaaacaaaggaaggaagagaaacaaaagagatgtgtacaactatgttctgaatatgttcaaacagcttgttattactaacaatcaccacctgacaataaattacccctctacatgtggattaaaagctgcattattatgatgcattagaatcaatctgagtactaacgataatgggtggcttggtggctaaacatggcccccaattactgccaagtgccctctccctttgtggctacaaaacaactgtcatcaatattctctcatagagagtgttttcttatcagtattacatcctcaaacatccttggaaagcaggtcgatattgatgggcttttctgaggaaaacagggaggcatggagaggttaagtgaaaatcagcagaggcagccctcctggcccatcaaagaatttgggttataaagggagctaaggtaaggaagcaaaggccttcagcctgctctttccatgatggcagcacctatggaatgcaatgggtcagggtttttactcaccctctcggctgtagtgaaaagcatataatccttaagccactgcatttagaaaatctgattgtagcttgcagcacagacccacagaagacatgtttacttctggcagagtccaatacaagcttagagtaaaagcttacttctgagaagaaaaaaagagtacatctcagttcagaaacagtataatccaccaggggtaatattttctagttacaaatgaactaacagatactgactgagcccctgttgtgctatttgttaatggctgagagggacacaggagaagcagaggactctgagaagactgaagctctttcctcagagagcttagcatctacttgtggttgggtgtagacaaattcacacacaaaataaagaccaaacaagcctctacagaagtcccaagtatagagcgacaagtctggtttggcatactggttagaggaaaagatgggatgtcggcacattcccgcatgaatgttaccagtaagacttacactgccaagcatattagacatttccatcagcagtaaatgcactcacaacaggggtgaccaagggagatgaacaggaggaaactgaggtaaatcagaaggacagatgtcgttaaagggaaccaggagggaggtgtctgccattatctgaatacgatcgtgtcatttttgaaccaaactccaccgacagggcctgcttccctgggtacagtgcttttcaggcaagtactcttggttggcatgtccctatatacatctaagaactagagggcaactgatttaagattgagtgctctagtgagcacacagaaggcagataatctgtgttgtgggctgaagagagcgagtcacatattttagctattaagacatacaaagtggtcaagctgtcattctgtttcagaaattaaggcatttgacttgtgtgcctgtccagatggagtgttattccactcatagtatatctgcagggagggcttgaactttccttcaaaaagcattttggatcattttagcatctttgctagggttcacagtgtcccagatgatgccttcttgagacaacttcacttcccattctcctctgctccacagccacaggttacagacctcactttgccttgtcttgcaaacattactggctataggagactcgggcagagggtgtggatggctttagagaactctaccactgcacacacacactgtcctggacacagtggggcagcactgttactgtcacaggtgaaactgatctttgtaatgagcaacagcctacagagcttctggtgacgtacttgtaaatttcccattgtgaataataaaattcagaattgcaagctgattgcatttctttctataggacctattctctggaacagaaaattggcaattgctatctctttttcagacatttgaaaaagacaacaattatgcctaaaggaactatcatgctataagaagtctgtttgtgatcccagcccctatagattcaaggaattttaaccctaataataatctagatgcgactttatagtgtaagagtccatctttggatttttccaggagtataaatggcacattattacatgactgttacttgtagaacttgaactgataagtatatcagacacatacatcaggagcgcatgaactcacaacagggttggtcaaagggggtgagctggaacgagagagcctgtggtaaattaggaagacagatgaaggttaaagggaaccaggatggaggtgtctgccattatctgaatatgaatatgtcttttttcagccaaacttcggtgataggccttgcttccccaggggcagcatttctcagagaagcaagcttagaagtcatttgggaagaaatatttctttattctgacatgagcagcttggtagaaaagatgagcagacatttgctttgggagcaagaggtgctaagcttaatgcccatcatctcctagaaatggtgatgtattgtatatacacatggaatgtctgcagctgcttgctatttcctggaggtcagagtacgcaaccttttatctctaaatatctggttttcaatctggctgtatcttgaaatctgtcttgaatacagctcagaaaggaaggttttggttaagcatgtagttactaaccttcaagcacaacagaatgccaggagagcagcctgacctttgcagtaaaattaatttgatgcttacaatctaacctagagtccatagcctttattcatatgacagagtcacaggacaatttagcggggattattaaattccacctaagctcatcagaggagagaattgaggttgatgcatatctggaattaccagtgaattcgccaaaccacgtggggaaaggaaaggcagatagacttctaggaataaagataaggggctacacttggtatgtagtaggtactcaatgagaactgattcagtgaatgaggcaaaagagtaagctgaatctgctgtctgacaactagagagacccttccttacacccacaggtgcaacttcaatccctatgagcttcccatacagcgaagtcacttggcaagtgccagagatcccaaggtgaggatggagggtgagtgggttgggtatggtacaagacatgccatccttctgcattacccttcccattccagttggtggtaggaagtctggggcaggacattgttattcagaaacaaagaaagctaatggataccaatgaatcaggagggatgcattttactcgaagtggctaagagaacctcaacagaagaactttgttgggtttccagaaagcctttgcgacagtactaccaactacagcactacccagggggaatcagtgttccagtcactgcacttaaacaagcatgttatacacaaaagcctaagactgtttgcagtgggaaatcctggttggttttatttaggcaatatagtaatgtagctttctgaatctgatgttctttatttgaacattcattatgatgattcatctctgcttttctttctttaccaatgatatttgcattctactaggaaatataattcataaaggatgataaaggaatcaaaattatccaatttatttccatcaaaggagcagaaggaatccagcaatgatctgttctgcatcattctgttttcagtacgtttttctttaagtcagggtttgtagcattaaatattactcttcattgcagaatcagtactaatttaacatcacaaggataatctggttttgtctaagggacccctccccattttgtttcccaggaactgaacattttccactccggatgttctcttgtaccatagaaagtattctgactctgtacctctctaagagatacgtagcactaatgtgactctctaaatgcctattagcattttaccttgtattaatagctaaccgggcacccttgctattttccctgctgagatgtatcaataaaaactttgatggcagggatgacgcctaatatactgtcaaattacccgtccccccgcaggatatggcatagtgaatgtacaaatagccaacataactctatcagtttttgtcttcttcaatctgctgacagtattgtaacacctgacaataattgcagttcacactatttgttggtattttttaaagtggaaaggctttccttaacttttataaaaattgtcctcaagttaatcttgctaatgtcttccatactaatttttttcttttgccaactgaactcagcctatatgagagcaataaaatctactagggatcctctggtgagctggttgattctgcctataaaaatggccttaagtcatagagataatatcggggaatcaggaatgatgttcaaaatattcaaacaccagcatggcatgggcaaccaaacagaactgtatgcaaaaccttagtactggagcagagcctgggagaccctcttgctgtgccatgtgggcatgtatgtcggagcgatgctgtgaatctccagccactattttcactgtggattccacaggcatcaatcctacccatggagcctgtgctttgcaaggaaatctcacaagggaaaggactttgctttgttagagagctctttatattgcagttgaagagaggtaaaggagttgtttctggggtatttccttggaacttgcaaataaagacttgtggtgggttctgcctccaagctattggaagagactgactagacagttacaggcttctccattttcatgcctacttctgcctcctgctaagttgcatcagtttcaaacacaaaggttaagatgtgttacctgggttaagatgtcttagccaggggtcaatccatgactattacactgtggggaagtctaggtgatactagagggatcagggtggcctgggtgacaggtgatcacttagagggctcctgacagtgcttatttaccaactggtacagaagtttttcagtatctttaaactggtatgactgtccagtgcatattggctgactatcagcctgaagagacctacttttcaccagaacaggcagcaaaagtaagcagatcctcctacccatagctgcagtctccttaaaaaatctgcctcagggttcaaggaaatctttgtgatccaagttatctcttatactaacccgaatgcaaaaacctttcctatagaaatattaacatactccccttattctgtcttcccagggatatgaacttctaatcactttttaatctgttaaacatgttttttttctttaaagaaactattatttaaaattgcttcccagtcatttttgagcctaaaaacaggtcccactatctattgcttttccagtccttgcaataattgagtcgagcatggatagctgagaagtagaatgagcagctctccttgctgtcttctgcttgagtgaagaaagcaaaaaattttgtaaaatggcagaggcaggataacatggagctctcccttcaaaccattagaagcaacagaaataaaagtgccatgtttttgtgccctttaacaatcatttttttattctagtcccatatccgggtccctgggtgacagacctaccccacctcaacatgcatgggctggctgcatgtagttatcttgttctctttccacacctgcacatgtctattcaatggggctgtgttacaatcaatagcaaatacttatctgctgggagactgactgagttccaagaccttggttcacgtaaggctgtctttgccatctagtgttaagttttgtttgcaggattactagtgaaatttctcaggaagctggataggacatatgggaaactgccaaggtgagtaattcctgcatctctagaggtgatagctacagcaacagtagcttattgtgagtagacaccagttgcaaagctccttaggcacaggctgggtaaaggggtgaactggaataataatttctgtctagatggaatgtctaagcaacaacattgagcatgaagtgttcatcataccctagtgctgggaagtcaaatcctagattcttgcttagtgataacatcatttgacaaagtaggaattcacacaaatatatgtttaaaagaaaagaccaggaacatcgtatataccttactgtctggagtatctctcaggttggacgctagacaaacaaaagaacttggaatacacatgaacaaacagtttcagatggcatgttacatagtagctcagaggcagaacccacaagtctttatttgcgagttccaaggaaacatcccaggaacaactcctttacctctcttcaagtgcaatataaagagctctccaacaaagcaaagccctttcccttatgagatttccttgtaaagcagaggctccatgggtaggattgatgacaatggaatccacagtgaaagtaatggctggggatacacagtatcaccctgatatgcatgcccagtggaagagactgaccagacagttacaggcttcttcaattttcacgcatactgctgcttcctgctaagttgcatcagtttcaaatacaaaggttaagatgtcttacctggggatttcacttatgcaatagatgagccaaacatatatacgagtacaaatggctgcttgtgaagtacctgaagtttttccgataaaggaggaatttggatgtgttacttggcctgcactctgccaggggcatatcgtgctgacattagaaaaacatgctcttttcaacaagatttagtctcacttccctttgcctcctggtctcttgctaatgactggaagtagaatgagagttcgattttacgatgatttagaggtctgtgagttggctttctccctttggtatgtgaccaacttcaaagaagcaattgtgtaactactaaggaaattagttctcttccaagggatagagatcttttgtcataagtgagaatgagtaactaagctctctgactctttctcaagagggcccctgggctgaagagggcctggctcgtggtctaggtttgctcactggagcagcaggcagtcagatggtcaaaaaatattgcttgtattccttttgtaggcagaagcactggagtagggaggtgaggctgggtgaagggaagacaacaggaataagacagtaagtaaatgaacagatgtaaagtatatagcacaatgcctaatgggcatacctctttatatagcttccactttttgaacacctcctctgtgttaactactaaaataagcactatgcatttaatcctcacaacaacattatgagacaggtattactaatattcttattttatgggggagcaaaccgagccacagaagtttaagtaaattgctcagaggcttcagaaatagtaaaagatggggtcaagatttgaagtcagatttctttcttttggccctaggtatcaggctttgtgtttgatatattactaacgccaaatcctcataccattcttgagttgtgggtgtgattatctccaattacagttgaagagatgaaggttcaacgtgattaagcaacttgtccaagatcatacaggcagtaagtggtagaatgagaattctaatccaagcctgaccccaaagcccatgctcttaaccacaaaactctgtgacctcttttgcaatctgacatattttagacagtcttcaaatgtttgtccccatctcaaatggtacagtgaaggtagatggaagacaaagagttgaaggtaacttagactcggtagtcagagcaggaaaggttgcagagttgagctggaatcacatcttctgttttctcttggggctggtgttgagcaggatgtagttagaggtgataaaagacaatgaggcaagaagcaactgatttctatcccctcatctccaaattataagaggaagagagatcactcagaatacgagctagggctaggcaataacactattagagagttactattacctgaggactattacctgagctatgtaggtgtgctagttatcaatctaatacctcttagctccaaattcacccttgttgcctgctctgtgaaaatggttctgggccctttatatatttttcctttgccagctggcacaatgttaagctttgtcagtagagggcgttagggagacatttcaggaggaaggggcttttctttgtgggtcctgtgtgctggtgtgctaggtgtgctcacttggcaggttcctgtagttcaggctttcagcttccccagggcccagttcccacagcacacacagctccccaagcaccaggttcctgcagcatgtgcaatttttcaagcatgcagctctggtagtataatcagcagtgcccagcagcttctcccagtacccatccctcaggatgtttcatggtggggtgcctattgtgagatacctctctgtgaccagctttccctgacactatagagggtggatttcccagaagttccacagggcagaattccagcaagttctgctgatgtagtaccacagcaatttctctgctatttaatgagtcatgactgtgcccttgtcctgcaagatatggatctcagccctggggaaaaggttctctcctgggtgccctagttcagctctaggtgtaggggctgctccttatatttgttagtcctatattctttgtagttgtttttacttcttactggccaatcccctgttatagttaatatttatattaaaatttttctgttcaaattactgtgtgatttctctctcctgatgttttccagacatatagggttaattcctcttcctgcatctcaacattctgtaaggtgatgactagggcaaagggatacttctagggatacctacattcgtaggtagggaggatggacttttcctagagacaaggtccaaagagaaaagagcattttctttttcaggaggtaaaagatgacttctctgtcttgctttttaatatacaaaaatgagttagaacacgtgtggcctttcacttgctcaatttttttcaatgaggaggaaagaacctgttagataggaaaggaaactgaagtctgtggactgcgtggattgtgagactcaaaggactcatgatcattcagagtttaaacagtgcttaaagctctatagcccaggtattccaagggggaagtgactacttgtgatgatagccttcaaatgactaccatctttaatataatgaccaatattgtactcaatacctctatgactacccatacaacccttactcaaagctcaaggttatatcccctcctctgcaagagatcaaatgttttctttgcttaaaattttgcttttccatggacatatgtatagaaattttcagacatcataaaattcatgaattctggaaaaagcttctgaatcctcagggtagaagtttggggtttagagtttgcacatcaggatgttttccaaatatcactaagagaaatgattttcacaagtgcagaataccatcataatttttatattactcatggatttatgcagctgagttccttttgaatttgagtaaaatattttccaaaacacttgttgttaattaactactacctttctaccgtgactattttttttgcttcctgcctccaaccagctcaaagtataatactgtctctccaaagctcaatgactaagaaatggaaggcaagtagttaaataggagataatatggaaacgtaaatttcaaggtctgatcatcaactaaaatgctccctatcataatacaaattcatctttgtgatatttatgaagcattggctcacaacaaattcagaaatactaaaagcgtcacagctaatcagatggcctgctcaatcactagaaagtttctaacatacacttcccatgtgctagaaccctcatagcaataacaacagcattggaggccatagcagctttcgataaagaatgtttagccaaagtggcctggaatacctatggtctttgagaggcttccacgtggtcctccagatcatccaaggtattgtgtgttcatgtgtgggtgaaggtcccaatcaacacaggtgaaagagagaagtctgagccacagggtacgattctcctgctagaaaaccagtcaattaaagtttcagaaaatcggtccaactatagtctctgtttcccttcctgtgtttgctcctccaaattttggttctggcccaagttcttagatgccttcactagccttccctttgtcactctgtcctccacatatacgcacatgtatatacacagagggatcatataaccaagaatagaatgggaaaaggagcattgtttcagagcagtctgatgttttatactgcagtagctggtggggacaggtggaagtgacatgtagaaatttgttgctccagttagaacttcctaaagaataagaagaccattgatattaaccaggagttgctgtgaaccaatgcagacctgccttcatgttcagaacagaaaccagtcctatgttgctgccattataatgattgtagattagagcactagtttttacccagggtggttggatggtctggcacataaagaactggtactgacaggaggagaagcctagtgtttaagatgggcctgtaaatcaaaaagcatctgagacaagtctcaatcaatttagaaagatcctttgccaaggttaaggatgcacctgtgacacagcttcaggaggtcctgatggcatgtgctgaaggtggtcagggaacagcttgcttttatacattttagggagacataatacatcaatcaatacatgcaagattgacattggtttgatctggaagggcaggacaactcgaagtggtggggggcagagggtgggatggggggaatggggggcttccaggtcacaggtagatttaaatatattctgattggcaattggttgaaaaagttatcaatagaaaggaatgtctgggttatgataaggagttgtggagacctaggttagagagaatagactgtaactgtttcttatcagacttaaggtctgtgttgatgttaatgctggaggggtataatgaggcatgtccaacccctactactgtcatggcctgaacctgtatttcaggttaaattttagggtgccctggctgaggagggatacattcagatggttgaagggggcactggaattttatttttggtttacaggcctaaggatcaagacctgggtttgattatcagattccccctatcaatgagcaaggtacttaatctctctgaattagttttctcatgtgccaaatggtaataatagtatgtgcattatagaatgttttaaggactaagtaaaataaggtgcataaagtttacggtacatagcaaaaactccatatgtgttagctattattatttctatagttttatttataaaaggcataaagccataacatcttctgttgccttattctcttttgctagttttggagatgtggatagaggaggtgttgccaggggtaacaaaagatgggagccatacaaatagtctcaattgatttttgacaaaggtgcaaaaccaattcaatagtttttaacaaaatattactggagcaactggacatccacagttgggaaaaggaggaggagaaacttgatctaagtcatactcaaaatgaaacacagtatccctgaagaatacagatgcaaaaaatttcaacaaatttaacaaatactaatgaaccaaattcaacggaattctattaaaaagatcacacatcatgatcaaatgggatttatccctaggatacaaggatggttcaacatacaaaaaataattaatatgacattgagagaataagaataaaaatcacatgattgtcttaatgggtgcagaaaaagtatctgataaaattcaacacccttttttgataaaaactctcaacaaactggaaatagaaggaaaggacctcagcataataaaggtcatatgtgacaagcccacaactatatcacactcaatagtgaaaaactgaaagcttttcctcctaagatcaggaagaaggtaaagaggcccactttcaccacttctattcaacatactactggaaatactagccagagcaattaggcaagaaaacgaaataagcatccaaataggaaagcaaaaggtaaattatccctgtttccacaggacatgattttatatatagaaaatcccaaagactccattaagaaaatggttagaactaataaacaaatatagtaaaattgcaggaaacgaaatcaatatagaaaaatcagttgcatttctatacactaacactgaactatctgaaagagaaattatgaaaacaattcctattaataatagcacgaaggagaataaaatacttagtaataaacctaaataaagaggtaaaagacttgcataatgaaaactacaaaacattgacaaaagtaattaaagaagacacaaacaaatgaaaagacattccatgttcatggattgaagacttaatattgttaagatgttcatactacccaaagagatctacagattcaatgcaagccctatcaaaaccccagtgacattttattttcacagaaataggaagaacaattttgcaattcatagggaaatccataagatcacaaatagccaaatcaatattgagaaagaagaaagctggaagcatcacatttcctgatttaaaaactattacaaagtcgaagtaatcaaaacagtatggtactggcttaaagatagatatgtagaccaatggcacagaatggagatcccagaaataaatccattcacacacacacacacacacacacacacacgtacagttaattgatcttcaacaagagcaccaaaaatacgcaacagggaaagtacagtctctttaacaaacagtgctggaagaactggatatccacatgcaaaagagtacaattggacacttattttacaccatacacaaaaatcaactaaaaatgaattagacttaaatgtaggacctgaaatgtaaaactcctagatgaaaacagggggaaagcttcttgacattcgactaggcaatgatttcatgtatatgacaccaaagcacgtgtaacaaaacaaatataaacaagtgggtctacatcaaactaaaaagtttctgtacagcaaaggaaaaactcaacagactgaaaagtcaacctatggaataggataaaatatttataaatcatatatctgacaaagggttaatctctaaaatatataaggaactcctacaactcaataacaaagaaacttaacagcctaattttaaaaacaagttaaggacttgaacagacatttctccaaagaagacacacaaatggccaatagctatgtgaaaaaaatgctcaacatcactaatcattagggaaatgcaaatcaaaaccataatgagagatcaatatatacctgttagaatggcttttttttttttttaaagtgacaacaccaaatgctggctaggattctggaaaagtttggctgtttcttaaagaaatatgtaactaccaaatgaccccacaattacactcctgaacatttatcccagagaaatgaagacttaagttcacacaaaaacttgtacataaatgtatataactttatttataatagcaaaaaactgggagaatcccgatgctctcaacaggtgaatggtaaaactgtggcaagccctacaatggaatactcaatcaactatggatacacacgattattcaaatgaatttcaagggaattatgctgagtgaaaaaagccaatccagaaagattacatattgtatgattccatttatataacattctcaaaatgtcaaaattatagaaatggagtacacattagtagttggtggaaggcaggagggaggtgggcaatatgagaaacggaattgttctgcgtcttcactatatccatgtcaatatcctggatgtgatattatactacagttttgtaaaacgttactgggtaaaggatatatgggacctctccgaattatttcttacaactgcatgtgaatcttcagttatctcaaaatttcaaaaatttaatttttaaaaaaggaaaagaaaaaagatgtggatagacagaaggagcagactgaaaatagtctctgccatttgcaatacagttcagataggtgtcccagattatagcaggatttctagcttggcaggcgaatccactgtactgcagagatccctctggtgcaggaaagcaaggcagagttttcctgcagagccagcacttgctcctctcaccgggatattagttattgctcttacaaatttggaagctgagaggtgtgtcacaattaatgaaggttaggaggctctgggttagagtcagaactactaaagttcctgaaagtcctccaagcagctctgttgctgagatctaggctgctggtgcagaagcctcctcggaagtaatttaagcagagtggatctcaggggtaataggagtattcttttgcttggcctctgaaggagacgagggcaggccatatgacagctctctgtatggagacagcacggaaaagtaaaagagagggctgcgagttgtagaggagaaaaaactgagaaatcataagcttgacaagggagaaagcagaaatttctctgcctccatgtgtctgggtaattgggcatcaatttacctatcacgatgccatgcagtactacaggcaacttggaagaaaagtgttgggtaaagaacaactgagtgttgacatctcatttttaaaggcaaactgttcacacacaaatgattgcacagaatattaaagaccagccttcttttccatctggatgatggatctataaggagaatgcattcataccactggcagagtattttcaaatagatacaatcatctttcttgctgctctcttctcttctgtgatatcattaaacatttgattaacactgactttcaggccttcccaaacactggctccctgtttaccaaaaccactgaaaaatgcccaggctgaccactggcaatcaatagagttccttggggttaggtgaacatccaatgtgtctgaattgagacattcaaaggtgaattgacaatcctacttatgtgaatgcctgctgcagcttttgggaactggctgtctcacaggagcagtgcagggacatcaccacctctgtgctcattttccatcttccctaatgctccagaggcatggaggagaatcttgggtttccaagtacattttgtgttcagcccatttccacagggcatagcaccttcctgctgtttccaccttctcttctggctgccagctctattatctccatcagaaatttgatcctgttagaagtgctgtggggtatttttgtctattttttaaatagagccttccagtttcctttgggccattatgttctcctaaagcagtgctttgtcttcagtcattaatatttaatgtgactagaagctttcacaaaaacctattgagatgcacatgctttaggtggcaaagctgttatttaatgatgttggctgggtatactaattcaacctacccatgagggaaggtgacctcctggtccctctggttctgtgtctatattaataaaatggaaacctcttgccatttatgaaaatatctgttcaccatagaagagaggaggactataagatttttttctgacataataaaagtaactgatttctaaaaaattggaaaagaatattaaaaaatacaagtatgaaaagttgtacatacaataaatgtttattatggcattgctataagaagaaaataaattatgaataacccaactgtccaataacagaggattggttaaatacattagatgacatatttatataatggaaatctttgtagccagtaggaatgatgatgtaatctatctttactgacattgaaagatgccaagatacattaataggtgaaaaaaatcaggctacagaatagtatgtacaatatgattcaattgtttttattaaaaaaatagatacactggcaaaaaagccagaaaatgtatgcgatgaaatgctgatagaggttctctctgggtgttgtgattgtgaatgatttttcacatctttcttcacatttttcttctaaatttttaagcagtaggcacagtaaaattattttgctaaaaaatactacgggatggccaggtgcagtgtctcatgcctgtaatcccaacactttgggaggccgaggtgggcagatcacctgaggtcaggagtttgagaccagcctggccaacatagtgaaacaccgtctctactaaaaatacaaaaattagccaggcatggtgacgggcgcctgtaatcccagctactcaggaggctgaggcaggagagtcgcttggggagggggaggttgcagggagccaagattgtgccaccacactccagcctgggtgacagagtgagactccatctcaaaaaaaaaaaatgctatgggattgtggctatacaacttataaattacttttacttgaaattgtaatccaaatgaccttcatatttccattcaaacatctgtttttaatttagagaagaggatggcaaacttttatgtaacgggctatactaagtaagtattttaggctttacagcccatgtagtcacttgtaactactctgccttcccctttgcagtgctaaagcagccacagacaatatgacaattggtgtagctatgttctaataaaattttatttacaaaaacaggtagtgggctgaattttgcctataggtggtatttactgacccatgctctagggggctaaataaaggaggccgaagtctcagaattaagctagttttctctgttctcttgggtcaatgtgggtaatattagttgctgctctccagagtcaagaccaaaatggcttggagacatcactggagcgtctcatttttgctacttgagatgataattttcactctctatattggggccatgctttacatagggccaccttatccaccaaagtgaatcctagctctgccaaagataaagctgttgtgagagaagcccccaagtgactcagaagggttgaagaatttacaaccaaactactgagtgaccttagttagaaccagaaatttcaaaagaatcagtgcttcctgtagcccatccgtactaacatactccataaaccagttttctgaagaagcgaattattatagtgtatctacagaaaagcttttaaggagtcttaaaatgtccaacaacagcttaatttaggagtctgaaaaagacatacgtagctgaggcaaaatataatggggaaaaagaaggatgacttagccaaagatggtatggcactcctagtcacaaagagcaccacgatacccagaatagcagtggaacaaggttaactatgtgaatttagttcattctcttgtctttgccttaagttacaatcaatggtgcagtttcttaaagcagtttacttgacatatataatctataaagagtattttccaccttttctcttcaaagaagagttacttattgcatgcgcgtgcgcacgcacacacacacacacacacacacaacttacttctgaaatgcttccaaaatacatagcttccagatcaccccaatcctgccatctagaatattattaaatcacatttaatgttctggccactcaaagatagtcatctaagaagagaatgtattaggtccaggatccacggaaccagagccaactacttgggatttggggctacagcagagccagatgtcccaaatttctaacctgggaatttctgacatacagcacccaaaatttactgatagaatctcaggacttgcaggcagcccaggacacctgaggaacagtccacaacaagccattcagaggagtagggagtgggtaaggcagtctaagggggacaaaagaaagggaagtgggacaagatcatcaagagaaccaagaaagttcaaaggataatgtttcaaaggttcacaaggggctggaggatggagtcaagatgctaggtgctatgtgatctaagggcaaaagagaggaccagagaaggagcacagacatgctgttagtactggggcttctatttgatagaggcagattaagtgatttgttcaaggcccccatcagttaccttgaaatgtaaattcactctttcagtttctactctgatgttatatcccaccatgccatccagctgttcacaaagctggtgtcttttcctgaagatttaaacaacttagaaatattgtgtagtgtgtaggtgtgaaatagttgcttgactcctctgcggaggtggcagaaattttaaggtatggaaacttactgtgctaaaacctgtaagtgccatattctgaattaatagggctggatctttccagctgttcctggctagtggattaggcagcgtttccattttagagaaacaacactgaaatcactatagctacttaaaaaatctcaaatgtataacttaaatgaactgatgtagaggaaagcacagtggacaagaaatatggagacttgggaaacttggcttctagtgtcagctccatcactagatattctgtgttattttgactaagtcacttcctctctctggatgctagtttcctcacctgtgatatgagagggttggacttgataatctctaagggatctttcacttgtaacatttgatgattctgtaattcctggtgtgttttctctcctgacatttattcacaagggtcattctgccctccacacaatttaagtttttggcaaatcacagatggtctaaaataaaatctcccccttgaagaggggaaaagaacaggatgtttctgctgaaatagctcatgtcaggtatgacctttctaattcagagcagctctctagtggttcattaactcaccccatgggcagcacagcaagcaagtactatcacaaaaggccccaactgtgcagccaaagagagctgctctattacctgctgaaaacaaagtggtttcctctttgtgtccacatcggtcaatttttagatcaggaacatatgcttctatcactgaaggaatcctggccaactaatagaaaccatgtgccaagtctaacacctgctttgaagactaagctggagtcccttctacagggaagtgatggaattacttcgaaatacagatggtccctgacttaagatggttcgactaaaatttgtttgactttacgatattgtgaaagtgatatgctcagtggaaaccatactttgaattttgaattttaatcttttcccgggctagtgatattgggtacattagtctcctgtgacggtgggcagtggcagtgagctgcagctcccagtgagccacacgatcacgagggtaaacaaccaatactgtatagggtactgtgttgccagatgattttgcttaactgtggactaatataagagttctgagcatgtttaaggtaggctaggctaagctatgatattcggtgggttacatgtattaaatctattttgacttacggtattttcaatttacgatgtgtttatcgggcagtaaccccatctttaagttgaggaacatctgtaattgataagagtggttctcttttctagacaattaaaaatggttagaaggtttaatagtaattataatagcccatttttgtatagtgctttatattttacaacacatgctgataaatgtattttctcatttacattttcttaacaacccaccgaggtgaggagaataggtattactatcgccatctacctgataaggaaaatagggctcagagaagttaatgtttgtcccaggtcatagtaggtggcagcattgagaatggaactcacaccttgactttgacttgtccagctaactcaccaatatatttctccaattgtcctgttatacttgtgagaagttgtcaggaatataggttaaagaacagatcttagtacagggtctagatgctacaaagtaattttatgcttatttgaagacttctgacataggtttaatttgtcggaatgggatcggtggctaggagggctctgagaaaatacatataacacaatgaattcaattgatcattatatatctagagtcaaggcaaatatttactgaaaatctacacaagtgaccctatgcaagtgttatgagaacatatttaaaatataaaacatggttcctgacctcacaaagattcataagtggctgggcgtggtggctcacgcgtgtaatcccagctttgggaggccgaggtgggtggatcgcctgaggccaggagtttgaaaccagcctggccaacatggcataaccctgtctctattaaaaatataaaaaacagctgggcaaggtgacgcacacctgtaatcccagctactcgggaggctgaggcacaagaatcacttgaacctgggaggcggaggttgctgtgagccaagatattctgccactgcactctagcctgggcacctgagtgagactctgtctcaaaaaaaaaaaaaaattcacatgccctaaatagtgtataatgaagggttaaatatggtagtcacaacaataagtgctatggtggcatgggaaagagagaagtcagtgagggaaacattcatggaagaaatggaattaagcatttaaaggatggatagaatttaactggcggaggggaggaagaggatgattctagactaaagagtgagtaaagggtatgggaagagaacagcatgagctaaaccaaaggggcaggcatacatgaggttgcatatctgtgaggatactgatttgagtagagagcagtgggagaatgtcaagtagagccatgattcactctaagtgctcaaagggctgtctgcctttcataacattctgttcacttatgaataaaatgccattgaaggaagacataacaatggttaagagcttggcctttggagtcagacagacctgggtttgggtctcaggattaccacttacttgctgtattatcttgggttaattaattaacctcttggggcttagtttcctcttctgtaaaatgggcctgcaatgaagagcctatgataaaatcccaccaagtactgagcaaagtgctggcacatgaaagcactcattaaataggaaatgtaataaaggtgagccaatgaatgaaacttcatttttatacatttgttaagttttttcatatggaaaaactaaaaaaaaatttgatccaaccacttgctttaattttttattcaaattctgattcagaaaaccatgatggccatagctgtgggatggaataggagatgatgttgaacaagtaagttatggtttgatgctgcaggaccgtcatggttagtctgaggagactgccctgtggggaatatatatatgccttctgactaaggagaaggaaccacgggaatcagctcaagggcagttagcaaactgctggcaaaagtggcccaaggctgaaaactgctcatccttatctccatccacttgaccctctgagctcctttcattttctccctctaagaagcatttcttaaaggtatggtatgctggacacacttccctgccctcatatactttctgatggatgggaaattagcattttgttctgggtataatcgctttctaataagcaaagggtcagatacacggaggagtagtctaagaaacttcagggaaggaaaaccctggcttgagagaagtagaaggaaatatcagatgccaataacaataaacaacataatcccaggaaagagcaactgttacctgagcctggaaggtcatgaatgtggcgcatgctttcaaaataggagcccagggacatcgctgtaattaccaaccaaagagcctccccttagtaccagaaaaacagatggatacactaattaaagggggagagacggagaacaatgcaatctttgaatgtgagggactgaagagagtcaacctagctctgtttccgataaagaaaactgccctgttaactctgggtagctctaaccagccacagaaacctatgccaaatcaagtgttttcaaatagcattcaaatataattttcctttgtccagggtggactgcagtcttgcttttgaaataaatgaagcctgggaagccactctctatggccacatgtaccatttttcttatgtttaattcccctttctttttcagaggaaggggaaactcagattctaaaaacgacagcttgctgagcttgctggctgtcactgtttaaagaatggcttattaaacagatgatgtacaagcacttaaaaaagtaagtgctgaccagaaagccagtgtaagaacatgtctggtttggtacagataatttcctttttttttttttttttttttttttttttgtgaaagggctgctagaatgacatctttacagtgaatctttcacaactgccttataaaaaagatggagaaatgtagatcagaccagataataacttagctggattcctaactggttgaagaattgtactcaaagagtggtgatgaatggattgacaacaatttgaagggaggtctctaatagttgctacagggctctctacttgaccatgtcatgctcaatattttaatgtatgatttctggataaaggcataacaaacttgcttgctataactgtagataagacaaagttggagagtattcttaacttacttggtgatataattgggcttccaaaaaaatggtaccaccctttattgagtgtatttaaggcactactgtatataaactgtcccattgaaatcttaaagccaaataaactagggtttagagaggtttcaaatagcttatccaaagctacacagctagtaagtagcattgccaggacttaaacccaagtctgtctgttgtcaaagcccacactctttccaatacactacactgctagccactgctgtacactgtcttgacaaactagaccagaatatgctttctcctgaaaacaagacagaactgagcagaggctggaggctctgggaaacaagaaagaatcaaaccacatggattcaagagagctgactgtagctttcctgaaggattagagtagtgctagggtgacggtgaaaaccagcacttatactaataaactgctgagaatatttggagctagaagacagtgaatattgctacttcctggcattgttattatgtccagctttatttttatgagggaaagtggctggaatgatgggcccaaaactacgaaagcggaacataatataagaaaaaaaggtgggtgaccatagaagaatagaatgggggaaatatgacttcactatagttcatactagaaagagctaggagatttagtctgcaactttaacatgagccaacaacatgaaatgcctttcagaaaagtagatatacctcaggctgtattattagaagcactaagtggattccagagcctgagaagtaatagacacattgtcttctgctctggccaccattctgttgtgatgggcaaataacaacatttaacatcactagaggcttgaagtaactggggtgaagtgtttggaaactatttcctatgagggattttttttttttttttgagaaagagtctcactctgtcacccaggcaggggtacagtgatgcaatcttggctcattgcaatctctgcatcctgggttcaagtaattctcatgcctcagcctcccaagtaactgggattacaggcatctgccaccacacctggctaattttttttttttggtatttttagtagagatgggatttcaccatgttggccaggctggtcttgaactcctgacctcaagtgatctgcctgcctcggcctcccaaagtgctgggattacaggtgtgagccaccatgcccgacccctgtgagggaaattttgaagtaaatggaatatttagcttagagaggagaaaacttgtggaaactgtatttgaaggaccatcatgtggatgaaaagattagacttggtctgatgtgttttatattacaaagctaggacccagaaggcagcttatggttcaatataagaaagaaattcctaacaataagagtggtccaacatcgagtgataaggataataggttatatttaatgagtgtttcctaaatgcctagcactatggtccattgttgacatatcatttcatggaatccccataagaactctggaagggccatggacaggggaatggctacactgtaaagcagggatcttaatgtcacatggaatattcaaatacaggctagattaatagctgtcaggaatgtgtcatatgcaattgtgtattgggatgctggtggtggtaggagagttgaattagatggctctatgagttccctgtctgatataagactcagtaaatattctactttatctgttttcaactttataacattaaatattacgagctgatggtccaaagatagcattttgaactcttcgtaagattgctgctatgtgtctctgtttatacactcacacacacagagagagacacatttatttatttttaaatcatatatatgccagggtttgaaaaaagataaggatatcatttagatatgtggaagttttgaacaatttgaaatcctaacaatttttaatttattaattaaaccaatgcaacaacatgagaaaatagcatatgctgcatttatgataggcaggaattgaaatatacatcattttgttaaaaatatacaatgagaaaaatgtagaaaatgtaaatttcaaaaagctttcatttgaatgactggattacaggatgattctctggctctctgtggagtataaacataagaatttacagagctgtaacttcaactttctgtccatcactgtgctagaataggggttcccaacccctaggctgcagactggtaccggtccgtggcctgttaggaactgggccacacagcaggaggtgagcagcaggtgagtgagcattacagcctgagctccgtctcctgtcagagcagcaacaacattagattctcatagcagtgcgaaccctattgtgaattgtgcatgtgaaggatctagggtgtgtgttccttatgagaatctaaataatgcctgatgatctgaggtggaacagtttcatcccgagaccataccccccgactcagtctgtggaaaaattgtcttccacgaaaccggtccctggtgccaaaaaggttgcggacggctgtgctagaagattgaagagtattaccacatttaatctttgcaatgaccttataagtttggtatgaagatattatttccattttacagttgagaaaacagagtcttaagatagaaaagttaaacagcagtgccaagattcaaacacaggtatttctgcttcatactgtctactgtgctaaatcagtaccctcctcttttctttcctctgttaacggaaaacattttgaaaatatgctaaagtatagcacaaatgataatggttattattaataaacaactacaatgtccaatatccggattcatatgatgcttgtcttgaaaaaaaaatttactttgtaacagaaagcttggtctctttagcacagatagggacacatttggaggatcctggtttgttctataggcttgactttaggatcagaacaatgtgtttgaagagctattggagaataaaaaggcacagtaaaaagtgctcctcttctttccacaatctagattctaaagtgctgagagctgagaaaccaaacagtacatgtgataccacctactgcttattcactacatgcagaaccctgcaatggctatttatgaagacccagagaaagaagaccaacttctttccatgggagagctctcaatggaagagtgcccttaatgaaggttgtaaagcaatgcagtgaatttcctgaccagtctaagaactactgctgtatagatagtcgtctttttgatgaagcttcatgttcaccctcccttccctactagtataaaccattaaagtttagaaaaagtcctgcattcaactgattcttaagaatttaaataaggagagacaaaagatggcactgaagtactaaatactgccagaaaatatttggttggctagctccaactttaggcccttggtcggaatctatcatttgttctctgcagcctgtgatgaactataacctctgaatcaaagagagcatacgttctcacttccaagaagccatctatgctgtaaagaaaaattgctactgtgacaattcaagcaactggtgagaaaggtgagtgcatttcccagcatacacatttcttttaagcttcccgttaatgagcagcaatggacttcccagaagacactgtactcaccatttttcccatccagacaggacactccaggaacaattacaaaatcatgaacttcagtcacgtctgctgtctgacatagcttcatttccctagtggactaatgtgtacctgcttcactgccaacacaagagtcctcataaactcatagcttcatctttccttattttgggaccttgcttttggccttctcttatactttagttaagatgccctccttgttttagctattgaggatagtaagataacagctgcaaattagttcttggtgtctatcagaagtcagatttcttctgccttaattagtactgctttttaaatatcactgctatgatttccaacctgatatgtacctagggtccccattttcctccaacaagaatttcccactgccaaaactccctaccacaaaggaaagcagaacaaacaatcaagctagtctctaaccacaaatcaatcccatttccaactagctgatgaaaaatgtgagagtgacactagggtctaatcaagggaggatgggaagatgattacatttttgtctgttatcctaagccccaaaccaagctgggtggctgtgtctgtgtgtctgtctggcacagccagaaccagggctcccatgaggaccttctctctccatcataacaggacagctatgtgcaagtcagagatgagtaaacgtttggaggccagttaagaggctattagagtataacatgggttgctgacagtgaaaatataaaaggagaattatctgtgcttatctcctactcttaaatattaactgggatatgaaggagactggtgtcatggagttttcctaagttgtttgatggtgcaagctgcttttaggtttgggtggaagtgtgatttgaggcatttcccttggccagggaggcaggggagtcaagctatgaaaaatatttgtgaatcatggtttaaacaagtactctaaatgaagcccttaaacgtcacatgagatcttacattgtactctcctaaaagacagaacacaagtctactaagtttttgttttttttttcaactcacttaagacagcaattagcacttagcagaaagtctgaattcccccaaacctatttatatgagaaatggccttttaaatgaaaagtctgaataataaaaaaaatggaatcagttactcagcataagaccctttcaacaccaagggtttccacttattttcagaatttaattctcttgttcaactttgtaataatccatacagataaaagaaccccaagtacctcctggtttcagcagaatattgatcactacctctctgaatttgctttggagtttcaccccttggttgactcccagtactatatacagatgacctgttttaagacacaaagcagctctgagctgtgggcttcatgcccctgaagcagggttttcaaagagcttctctgctgagcaagctctttccacagtgcaattaggctcagccagaggacaaacagttcctcatcctatgtgtcttccattaataaagatttgcagcaatgtgtaccagacttggagcattactcagatctaccaagtccccagtttggggaagtggctctgattgattttggagtctctggtgtctttggacagatgtattcattcaacatgtggaggcctgcgggcaattcagattttagctgaggctgtagccaccattaaaacaggactgcagataatagcaaagattacaagcaaatgtagagttacatagttagaggaaaatactcattaggctcttgttttccccaaagttgtgaaaattcagaataaaaacaacaaagggcacagaaggttggtgtggcaaagtcagagtacatattaagtacactgcaacacattcagtacatcctgattttcaaagagaactgaaccaggaatcaagaagccataactctgtcatgtcacttcattttgagttaataagagctaacatattaagcacctatttattatgtgctagatactgtgggaagtatattactccttacttacattgtctcatttatttcttcacaaccactgtaggagtcttattaccttccccactacacagaaagcaaagagaagtgaaacacttcctgaagtaatacaggttacacagagcttaggtcagtttgatgcttaagcctgtgttcttaacctctttctatcactgcctgtcttctacattaagctccctacttagtagtctactctttttactaaattatattgactcccctctttaatttcttcacttactagactattacaaagttgaacaagagaattaaattctgaaaataagttgaaacccttggtattgaaagagccttaagctaaataattgattccattgggggacatttggatgggatgatcctagaaccaccttaattctaaaaatacagtaatttcataaagagtgaggaaaaaagctattttttctaggtgattgtggatatagttccagtagacacattccaacttggatcttaaaccctaggctgagtgactttttctcctgcgaatgttagttgcttgatgccctggagtactgaacttcctattcacctctctatgatggtggaatgacctctatgaagcaggctggggaattttctaagaaaccaggtcactgctgctgtcttagcaaagcacaaacagtgtagacctattctcattctctagttcccatggttctaggaggtaggctgagcctggtcctcagcatttaattcactttgcatagctttcttcttcagggcaggagctgggctaagatcatcttagagtctggcacaacaaaaaggccacctatggagtctactttcttatttatttgcatattttcatacagttggggcagcaaatattagatgcccatcataattaagaaaaagcccaaagtcccttgaagacatttaaagtgaaatgcctacaggaagaagagaggtttcctctagattttttattttaaaaaatgaaaataatgttaaacttcttggcactgcggctgaatattaagtagaaacatcttagggaaacttgcctgagagctatatgaattctaaactatgaaaacaagacactcagtagaaaactgtaaaggagaaaagcggtcagtttgctttatcaaagaaacaaagcattttcctccagggagaaaggaagcatgatgggaaatctgcaaacaatggacttctggaaggtttcatgtgtttgcttaaaaaccaaaataacaacaacccaaactccacagtactgacaggggacaagtgttctacctaatagcacatgggccatgggatatttccaaaaagcaatgatgttcagactcagtccccttgcgagcatgatttgaataatttttgccagacaccaccttcccccaagtctctaccatgatctagggacaatgctaaaatttctccctgttgtcactcatctaaggctcaaaaggaagagcatttgtagtagtgatggtggggcctttgacggtaagagtgagagggcacctctccatttattttgcaatttgtctctctgcttgcatttttgtctatgtcatagcacatctgtttttctgtctatttttctttctgtttctctgtccgtctctcagtccatccatcaattcctctctgcctgtgtctccttgtctgttttgacactctctctgtcttcctgcttcttgtcactgtatggttctctctctcaggttctgtctctttgttgctctttgtctgttgctcagtcagtgtctttctttcttctctctctctgttgctcccttcctccctctgcctgtctgcatctcactctgtctgtctatctgtctctgaccaacggcttctgacaatctatttacttttctctcattgtttaaatatccctgtttaagtgtccctgtctagttttcagtctgtctgtcttttggttggtctgcctggtgctctatgtctgccttcctgtctctgtcagtatctctgcctctctgtgcctctttgttcatttctttgtctcagtatctctgttaatactttgtctcttttgtctttctgtcagtctctgtatgtgtctctttttgtttctctgtctctgtgttacccatctgtctgtctgtactctggttatctgtccaatctgtctgcctgtttctccaccagcctgtctgtccacttgtttctctgggtgtctgcatgtatttatctcagtctttacttctatctctttgtctagctgactatctttctctataatttttttctctcaccctcttcctctctctcgggctgtcagccttgctgtgatcctctcagtttctctgtttcttgtcttttggcctataacacatggtatctgtccaactctttcagtctcccatctcggtcagtctctttgtcttggtttgtctgttgctctctcttcccaagtctgtctttctgtctcacagcctacgtttttctcttgtcaatctgtcttcccattcttctctgttggttttcatttctctttccctctgtatctgtctttctctgcctgtctgctgctctgtgcttcttgccacattagtccctctctctgtatctacctgttctgtctctttgtctccctgtcttttgactctattcgtacctctctgtttctatccatatctctctcattctataataagtgtccctctctctgcctgcctacctgtctgggtatctgtctgtctgtgtttattctttcctttagtagtttggctggctggctcactgtctctcaggctgttttcctctctctctttctgtcacaatgtcaccattttaaagtgaacaattcagtggaattaagtacattcacactgtgcatgcaagcactacttttatctagtccctgtccccaaatattctcatcactccaaaagaaaagcctgtactcattaaacagttgtcctcccttcctcccttcccctagccaccggcaaccaccaatctactttctgtctccatggatttacctattatagacatttcagagaaaaggaatcatacaacatgtgacattatgtgtccagcttctttctctcagaataatgttttctaggtttatctcccttgtagcatgtataattatttcattactttttatggttgaataatattctaccgtatggatatatcactatttgtttattcattcatccattgatggacattaggtttgtttccacctttttggctatcatgaatatagctgctatgaacatatgcagctatatatgcatgcatacatgcttgtctgagtacctgttttctatccttttggatatacccagcagtgaaattgctggttcatatggtaattctatgttttactttttgaggaaccaccaaagtgttttctaagtggctgaaccattttatactcctaccagaaatttagaagggtgccaatttctccacattcttgaaaacagttgatattttctgtcttttagattctagccatcttaatggatacaaagtggtatttaattatggttttgatttgcatttccctaatgactagtaatgttgaacatcttttcatgtgcttattggccatttgcatatatcttctttggagaaatgtctatttgagtccttagcctatgttttgattgagttgtttgtctttttgttgttgagttgtaagagtcctttatatgtcctggatactatacccttaccagatatatggtttgcaaatattttctcccagtatgttttctctcattttctctatgtctttctgatagattgaatctattacactgcctctttctgactacttctctgttggtgtctttgtatcaatatgtcccggacatgactctataaggctctacctgttccttctttcttcatctccctccttaacctttcttttttagtctgtctctttccttccttccctccctccccatctgtttcctctatttccctgcatgtgactccctctttttctcactatttctccctgccctcattcatctctcagtttgtctctctgtccatttagttggctctctatctctctactttctgtcttgctctctgtgtctttctgattctccctttattggttagtctatcagttgctttgtttatcaccctatctctctcccccagactctcttgggtctctctctctctccatctgcatctctctctgtattgccttttctcctatgcctcatggccctccctttctgtctctctaagtgtcttgtctcagtgtgtctctcaatcactgtctcagtgtctctctccggttctacctgattctcctgacactttttctgtgtctacctatctctctgcaacagtttctttttgcctctttctgtttctctctctccttgcctatttctctcgtcttcctgtttttctgcctgtctgtctcttagtctatcaggctttctttccatttgtctatctcctcatctctttctttctctttcctttgcctctcccatatagctccatctggccaactctctctgtctgagtgactttcactgactctctttctctcgctatctcactgtcttttctatcttgctgtctcttgtggtctctgcttctctctatgatgatctgtctctggctctgtatgtatctccctcacttctttctctgtcccttgctccttctgtgtgttctctctgctttgtctctgtctctgtcttcctgtatcacattctaactcttcatctctctgcaatacccgcaacaccccacttctctgtctatctctcagggtttgtctgtccatgtgagtgttatttgcttcttttctctttctgccaattttactctctctcttttcttcttgactttctttctcactcagtttctctctccttctgtctctctttagttctttagctttctctgcttctgggtctttctctctctaccctgttttctctctctctttgtgacctccccattctatctcttctgtttcagtgtgtccccatatctctctccttgttcctcactgctgtctctgttcctccttttctccatctttttctgtttgccagtctgccttcctttccacctgtctgcttctctttgtctgtccatctctctttgtatgcttccatctctctatattaaccagttgatctctatacctttatctatccatgtttgcctctgcctttctgtttttccatctgactggctctgtctctccttcttggtctatccttccctgtctgtctatccctgcctttatccacctctgtccattcctatctttatattcgcctgtctatctccctctggccatttgtctgtctgtctctgctcttctttgaaagcatgtggtatttatctttccatgcctgacttttatttccaggctgatccattttgctgccaaagacatgattccattcttttttatggctgaatagtattccattgtgtatatatgccacattttctttatccattcatctattgatacacggttagtttggttctatatcttagctattgtgaatagtgttgcaatgaacatggtggtgcaggcaactctttgatatactgatttctttttccttggataaatacccagtagaaggactgctggatcatatggaaaggggtggggagcatggggagaggttggttaatgaatatgaaattatagctagataggaggaatgagttctggtgttcttcagcaatgtaggatgaatatggttaaatatacttattatgtattttcaaaaagctagaaaagaacatttttgaatattattaacacaaataataaatgtttgaggtgatgagtatgctaattactctgcttagatcattacacattgcatacatggctcaaaatatcaatctgcatcctataaatatgtacaattattatgtgtcaactaaaaataaaaggaaaaatatggaaaaagacaaaaaagaagctgaagtataaaatttctttccaacctgtgccagttgaacacatgaatctcagagaatggacttatagtctttggcttgcgaaaaatgcatggattgtactgacttacgaaaaataagtctaacatgtctacctagtacttgaaaaacacaagtatacaccaactttggtatctttcaaacactgtcacttagttgtccactagtgaaaaacacaacaaaaatctatgtgctcagcaaagacatagaatcaacccaggtacctatcaatggtggattggataaagaaaatgtggtacatatacactgtggaatactatgcagccataaaaaagaacaaaataatatattttgcagcaacatggatgcagctggaggccattatcctaagacaattaatgcagaaatagaaaaccaaatactgcattttctcacttataagtgagagctaaacattgggtacacatggacacaaagatgagaacaatcaacacgggggattacaaaagggggaggggagagaggaagggaagcaagggttgaaaaactacctgttgggtaccatgttcattacttgggtaacaggatcattagaggcccaaacctctgcatcatgcagaatactcatgtaacaaacctgtacctgtacccttgaatctaacattttaaaaaactacatgctcagagcatgtcttgtaaacctttcatttggcttatattttaagtaagcttccagaactcaagaaatttgagaaactaggagttaagggacagactgcatcacataaaatatagagtctgaacagattgtttttgaaaattacatcaccactgaaacatacagtgatccagaattctgcagactaaattacatcagcacaatcacttgattttagtctaacaatctagtttggtaatcctatgatgtaagccctaataataaggaaatcattgaggcattatggaacaatgtcattaaacctctctgtgtctcagtttcctcatctataaaatgaggctaatgacagtaaatgaccttataaggttgttatcagaagtaaaggggataatccatgtatagttcttagaacagtgcctggtgcagtaggagctcaaaagaaaatgttagctgttattttttctattgttgttgttgcaattcttatcactgttattatcatataaacatctaaatagcactggaatcaggagagctatgtgactttggtaaagtctgctctctgggaagtttccttaactaaaaaatgaagatgtacctctaaaatttttatggttctatggtcctaggattccatgtgtttctgagtactaagcacatggggtcacatgtttttttaatttttaattttcatgggtacatagtaggtatatttatttatagggtacatgagacatttggatatagggatgcaatgcataataatcacatcatgaaaaatggggtatccatcccctcaggcacttatcctctgtgttacaagcaaccaaaccacacccttttagtaatttttaaatgtacaattaaattattttgactatagtcaccctgttgtactatcaaatactaggtcttattcattctttctatttttttgtacccattaatcctcccctccaccccaccaccactacccttcccagcctctggtaaccatccgtctactcactatcttcatgagcatgagttcaattgttttgatttttacatcatggggtcacatttttttatcaggctccatgatgtaatttttatcctcaaaagttgtcagacctatgttacaaaggaacaaaaaagccacaaggaaaatctgtttttcaaacatttctaaagctaacctgacatctgcaaacctctgctttctcactgacttatttagctcttacgggatcccacaacaaaaagcataaattcaggaatgacatccattctttctccaatgatgcccatatcagacagttggcgtaggtaacatttccacagatgtggacttcacccttgagagctagagtgccatatttttaaaagaggatattgtactttgcttcaaattgctgcctgcggatgttgtacccttcctgggaaggctatttatggctattgtatgttttttgtgaagactgtctaggatgtcatagctttcctggaaatagtctttgcatgttatatcttgcctcagaatggacgttgcttctttcttggaaatgctgctcatggatgttatcgtccctgggatgctgtctgtggttgctgtaactggcctctgaatactacctgtggatagtgtacttgacttttgatattcactgtggctaatttatcttctgacccgaggggccctccactgaagctgcttctccagtgcagtttctgagggagaactaagaatatgtttctggtacttgtgggtttgtaacttgattcattaacattttctccagactgaatggatctcatgccctaaactgtgttcaataaatataatctcttgccatactctgcccgttttctggatggataagctgcaggtgggaagctattgggaaagaggaagaatactaattggtaaattgactttgggtcttggacaacagcttgtagtacaaaaactctaacttattagctaaactaggcaattggcaatagttgcctctgaaaaagatgaaaactggaagcacaaagcatattcattcaggcaataatgtaccctgtactgtggtaaatgaatcttcacctttgtaagcacagtgctacataattgttcagaatatttcctgtgactaaagcataaaattttcatacgtcccataagaattctcaaatcttaattactcactcttctattttcttcatcttcaatattttccttaggatgaggatgtcaaattccctgtgggaatgtggcaacatatatttatcactaaaacctatcttgtctctgctcccctaatcctgccagcattagcatacctgtgctcattcatacacatgctcgttcccttacaaattcatgtctcccactcccatagacatgcacaatgcattttgtccaagctgtactggtgaaagaataaggtcatgtagctaaggaatattgatcttgaggggcagattcatagaatttacacaatgtagctccaagaaagatcctgattagttcctgcaccttcacattctctgcaaaaaggcatgacaggcagcagaaaataaccttttgtggttaaaatctttgtgctttaagatgaccagggaggaaagaggtatgatggggaagaggtcatcaattcaaaaatggcccttcccagttcttatgtttcaattcttttaccactgcttttcagaatggggatttagctgtacttaagtgtcctgtcccttaggtggtcattcacttgtcttaatattttctttttaattatacttttaattagaaataattatagattcatctgcaggcataaaaaataatacagagagatactacgcattctttttttttttgtaagacagggtctcactcggttgcccaagctggattgcagtggcacaatcacagctcactgcagcctcgacctcccaggcttaagcagtcttcttagctcagcctctcctgtaggtgggaccacaggcacacaccaccacccctggctaatttttattttgtttactttctgtagacatgaggtcttgctatgttgcccaagctggtctcaaactcctggtttccttgtctataaaatgaggcttatgacaataaatgactttatacagttgttatgagaagtaaagcagtcctcttgtcttggcctcccaaagtgctgggattataggcaaggcatgagtcacctgctcagccaatactatacattctttacccattttctcccaatggtagcatcttgcaaaattacagttcaatattacaaccaagatattgacattggtgtggtcaagacacagaacatttccatcaccacaaggatctctcatgttgcccaacttttatagtcataactacttctctctcccacatactatcttcttaacccctgacaaccaccagtctgttctccatttctataattttgtcatttcaagaatgttatataaatggaatcatacagcatgtaacctttcaggcttggcttttcactcagcataattctctggaaattcatcgatgttgttgcatgtgttgacactttgatcttcattatacttaattagtatttcaaggtacaaatataccacaatttaactactcacccattgaaggacatctgggttgttcgtactttttggctattataaataaaaagctataaacattcatgtatgaagtcttcatttctttgggatcaatgtgcaagagttcttaggcattttaagaaacagccaaactttctccccatggctataccattttacattcccatcagaaatgtatgagtgatctagtttctctgaatcctggccagaatttggtgctgtcattattttttgttttagccattctgaaaggtgatatctcattgtgactttaattttcatttccttaatggttcatgatattgaccatcttttaaaacacttatttgccgcctgcatatactttacatgaaatgtctgttcatgtcttttttcaattttctaattgaattatttattttttttaccgttgaatttgagagttctttatatatcctagatactaattctttgttggatatgtggtttacaaatgttttctcccattctgtttatcctcctaacacggtctttcccagaataaaaatgtaattttgataaagtctaatttatcaatttttttcttttatggactgtgtttttggtgtcaagtttaagaattatttgtctaaccttaggtcctgaaaattttcttctatttttttctctaaaagttttataattttatattttaaatgtaagtccatgatccattttgagtatatttttacaggagtaaggtttagattgaggttcattaattttacccatggatgtccaatttctccagtatcactgaaaaggtcagatgccctccactgaattgtttttgcacatttgaaaaattaattttgggaggccgaggcggttggaccagctgaggtcaggagtttgagaccagcctggccaacatggtgaaaccccgactctactaaaaatacaaaaattagccaggtgtagtggcgtgtgcctgcaatcccagctacccaggaggctggggcaggagaattgctggaaccagcaatgagcccagatagcgacactgcactccagcctgggtgacagagcgagactatgtaccaaaaaaaaaaaaaaaaaaaaaaaaaaagtcagttgggtgcatttatgtgggtagttttctctgttctctattctgttccattgatctgtatctgtccacaagcaccacacagtcttgattactgtagctatatagcaaaatttaatattgtgtagactgattcttcccactttatttttattttttttttgagattgatttagctcttataggacttgtgcctttctacataaatgttaggataatcttgcctttatttcagaaataccttgctaaaattttgatagagattgcattgaatctaaagattgatgtcatgagtaccgacatatttactatattgtgatttctacatgaacataatgtgttactccattcatttaggttttatttgatttctttcattagtgttttgtgattttcagtatacagctcctgtacacatttcagtaaatttatatttaattatttcattttatttggattacttcaaatggtattgtcttttgaatttcagtgtccgtgtgttcatttctaatatagataaatacaattgatttttgtatgcttatcatgtatcctgcaaccttaatggactcacttattagttctaggagcttttttgtttctttattccttttgtagatttcttgggattttctatgcaggtgatgtcatctgcaaataaggacattttcacttttctgatctgtaagccttttatttcatcttccctcatttttctgatctgtaagccttttatttcttcttcccaccttatttcattggctaaaactaacaacattatgttgaataagagtgtatatccttgccttgtttctgatcttaggggaaaagcaattcagtttttcacaggtacatacaatgttagctgtaggtgctttgtgaattctctatcaaattgaggaagtggctggacacggtgaggaagtggctcccagcactttaggaggctgaggcaggtggatcacgaggtcaggagttcgagaccatcctggccaatatggtgaaaccttgtctctactaaaaatacaaaaattagccaggcgtggtggtgggtgcctgtagtcccagctactcgggagcctgaggtggaagaatagcttgaacctgggaggtggaggttgcagtgagctgagatcatgccactgcactccagcctgggtgacagagcaagactccatctcaaaaaaaaaaaaaaaaaaaaaaaaaaaaaaaaaaaagaggaagttagcctccactcctatttctgagaggttttttttttttttaaatcatggatgatgtttaagtttttcaaattctttttctgcattgtttgacaaaattatgtgatttttaatctgtagcctgtgaatatggtagattacattgattgattttcaaatactgaaccacccttgtagccctggaataaaccctactttgccatgctgtgtaattctttcaatatattcctgaatttggcttactaatagtttgttaaggatttttacgtctgtattcatgaagaatactggtctgcacttttcactttgggctgcttttatctcatttttagtatttgtgtaatattagtctcatagaatcaattggaacttgttctctcctcttctatttcctggaagagattttatagaatttgtggtaattcttctttataagtttggtagtattctccagtgaaaccatctcgccccagagatttgattttgggagattttaaatgatgaattcaactttcttaatagttatatggctattcaaattatccatttaaacttggatgaattgtggtagtttatatttctcgaggaagtggttcatttcatgtatgttgtcaaatttatgtaggtagaattgttcatagtagtcccttagtatctgtgttaagtcattcttgtattgctataaataaatagctcagactggtaatttataaaggaaagaagtttaattgactcatcgtactgcaaactttacagaaagcatggtgctggcatctgctttgcctctggggaggccttagtgagcttttactcatggacaaaggcaaaatgggggacaggcatgtcacatggtgaaagcaggtacaagcaaagggctggggcagggggaggtgccacacactttaaaatggtcagatctcctaagaactcaccatcatgaggacagcactaagtcattcatgagggttctgcccccatgacccaatcacctcccaccaggccccacctccaacactggggattacatttcaacacaagatttgagtggggacaaatatacaaactatatcattattgatagtttgtactgatagcctctgtttcatttctcatattggtactgtacgtctttttttctctgtcagtcttgctaaaggactgtcaattttattgatatttttcaaagattcagttacttgtttctttgttttctgttttcaatttcattgatttctcttcttatctttagtatttcttcctccgtcttgattttagtttattttgttcttatttctctaaacttttaaggtgggaacttagattaattcatttgagactttgcttcttttctaatgtatatatttgcaactataaatttcctcctcagcactactttagctgcttcccataaattttgatatgttgtattttcattttcattcagttcaatgtgtttttaaaatttttatacttggttgggctcactcctgtaatctcagcactttgggaggccaaggtgggaggatcacttgaggccaggactttgagaccagcctgggtaggtaacatagcaagaccctgtcactacaaaaaaaaatttaaaaattagctgagtatggtggtgcatgcccatagtcccagctactggggagggtgaagtgggaggattccctgagcccaggaggtcgaggctgcaatgagttgtgatcatgccactgtactccaccctgggtgagagagcaagatgctgtctcataaaaattgcttgagacttttgctttgacccatggtttatctagcagtgtgttgtttagttttcaagtctttggagattttcctattacttttctgttactgaattctcgttttattccattgtggttggagggcatgctctatatgattcaaatttttaataattttttgaggtttgtttaatgacccacgatgtagtctatcttggtatgcattgtgtgtttaaaaagaatgtgtattttgctcttgttggatcctattctttgattattttgctgagtcctgatacccttgtggattttccatctagttgttatatcaattattgagagagggatgttgaagtacttaactatagttatggatttgtctaatcctcctttcagttatatcggtttttgtttcacacattttgcagtactttggtccatatgcatttagaattgctatgtgttcttggtgaattgatacttttatcactatataatcttcctctttatccctagaacttttctttgcaatgtagtctactttatcttatattaaaatagtcactcttgctttcttttgattgttttcccatagttttgcttattgtgttctttcttccttcctgatgtttcgaggtttcaggcaggggaggggggtgttattgcctcattattgccaaatggatgtagaagtccaggttccctactcaccttccagtgatatctgagggaggtagtctccttgttactgatgggcaggggtgggagttccagctccccagtagtctccaatgacactttgcaggagtggttttttatttctgggtgataaatacagtcgtgaatctcctggaggtctcctctgataccactttagtgggtaggagcaccttcataactgttaactgtcagagacaaacagaagtccaggctccccagatggcctttcctgttacagtgggataggagtgggttggatcattgtggccagtggggatgaaagttccagcttcagcctgggcatggcagctcacacctgtaatcctagcactttgggaggccgaggcaggaggatcacttgagctcaggagtttgagaccaacctggacaacatagtgagacctcatctctataaaaataaaattttaaaaaaagttccagcttggtactttgccttctctgatatgatcttggtggagacccctggcagaagtgttgatgtgcctcattaaagcttcatgaaggtagaaatctatgctccctacttggttgggagtgggtaggagtaggaccacaatttgtgtgtgtgtctggtgtctggctagagtagagagcttagctattgtctacaagttttccttgttactaggcttcctagtcctttggctaaagagcgtacgcttttgttggggcttttattttgtctgtacccattggtgtttctgagttaccagtttttttcaactccaagtacgagatatatgaggcaaaaccaaaatctccgagtatgagatatgaggcaaaaacaaaatccaaaaaacttgaggaatgtcacgcctcaagttctgatgtccctagacaatctgccttctctgcagctttcagccttcttaggattttttaaatatataatatccagggtttttagttgtacttagtgggaggaataggaaaaagcacatctaatccatccttctggaagtggaagtttcccgatttgtcttaaattttaagatgctcatggttaaagggacatatataacctaatttcttcatatgatttcatcttctgctagtcttttacattttttcccattacacattgaacccccaaccacaaaagaacactgagatccgataaccacctccaagtcattttttctccattgagacagtaaaacttgtttcctaaaaaggtatagtacagtttttttttttttttgatggtgggaaaagaagagtgtgtgtagcaaagaatgaagaaaaggtactaggtaaggtccaatcaatcaatccatcaatcaatcatagctaacagacttgcagatccaggctaagagcacaattttttctctaacaactgattcatcatacaccttagttttctagcacattgccctaattcagtaccatctgccactattagattaatatacaattatgattttgagtaccaaagtcataatatgcagagcttaaagcttttgttgttggtaacatcctaaaagtacatctatagagtaatttcataattaacaaaaaagtacaatttaatgaaagatgtttagtggatttataaaaggttgaaatttcagtaactattaaattttaaactagtttgcttagtcatttggggtgatctcatgcaaattaatatttctcagaattattaattatcagacacaataggaagataatgattgcttgacagaaagaaaaatgaggagtaggaggaataagtaatgctagcaatgacaactgtcatttacccagccttattttatattaaaagcattgggctacatactttatgaatttgtatttattttagggtctcaggtacattaaattggaccagtcatgacacttggttcatgacacactctcagcagtggtccgctagttatttagccagttattttaagtaatgtaataagcacctgtaaacctacaacccaaaataaaagctaagatcttgataataatctacatctaaatataagagttattcatccccatcctacctccctccctcctcctagccaaggtaaccatctcctaaatcctgtgttcattatccacttgcttttctttttatatagttttattatacctatatgtaatctcaaaattatatgttttaattttatatttaacttcataaaaatataacatgctctatgtaatcttttaggccttcctttttcacctaattttatattgctaagattaatccatattttgtgtgtggttgtagttcatttgttctgaatgctgtataatatgccactgcatgactataccacattttattaatctattaataatgctgatgagaatttaggttgtttctagatttttgtattgtgaattgtgctgctttaaatatgcttgcatgtgtctcctgttatccatgaatgaatcaaagattctcttgagtatttacctaggagtacaattttggggtcacagggtatatgtatgttcaactttcagagaaaatgccaaaattgcttgcagcaatttgtatatattcctacaaataacacataagaaatcatgtgcttctacatttctgggctttttattattctcaagaatttcatatgtctaacactttcctttcttagcatgggttcctcatctgaaccacagaacatagacaattatttgagtgtctatctatattctcaattctctaaaagatagtatatatctagtattattctaattacataagaaagaaatcaattatttatatgcaatagatgtcttaaggcattagtactttgttctttccaggaaccccaatttagaaggactgcttggtattgtcactttttattttttgtcaaccaactgggtataaaagatatcttatgtgatttgatttgcattttcctgattcataatgatgttttatctctgaacaagctaactggccaaatgtgtgtgtacaattttctgaaatgtctgttcatgtcctttgtccattttttctatgggactgcttatgttttcttaataatttttccaacttctttatgtattcttgatattatttctttgccagttgtattttaagaatattttctctcagtttgtaacttgtcttttctcattctctaacatgtattttgatgaaaaaagttttaaattttaatacagttaaatgtaccaatcttttattttatagtcgattctttttgtgccttaacacatctttcactatttcaaggttaggaagatattctatgatattttctattaaaagttttggaattctgttttgaaatgtatactcttgtaattgatcttgtatatatggtgggaggcaggttttattttcatttttcttcatatggataaccatttttccagctccatttgttagtctccaaatttcccactgatctgacatgctacctctgtcacacatcagacctccatatgcacatgggtctatttctgggttattatattctgaagaattttacattcattatttcatgtagtcttcacaataagtaatttgacattatttcatgtaatctgcaaaatcaccttatgaggtaggtgctattttctccattttacagatttagaaaatgaaagcttagagacactaattactggtaagatcacaaactaatctatggatgtcagctctaagccgaagtttccagagcccaagctttcaagccataatcaatactggctcttactctactacttcataagaatgttgcaaaagtcagtaaatatcacaggcagtaaactatatgtttagctctgtattagttactgggtggggtgaggtagggtcaaggatactgttgtgaaggaaagacaaaattgtagcctttgttcattttgtgtacccttaacttgctttattattattgctttttgaggtaattaagtaccagaacttatatatctatttgtttattatctgccccactcactagaatgctacacgagagcaggaacatatattgttttatttactgctgtatacctatcaactaaaacagtacctggcacagagtaggcatatgataagtatttgtggaatgaatgaatgtatgaatgaataaacatgataatgcttctgtcactggaatatggacaatctcacggaaaatattttgagttcaaaaaaatcctatgaaagtaggaaaaatttactcattcactcaatacatgtactgggtacctactatgcatgtagcactgtgatgagtactgatagaagagatacaaagatgagtaagacatgaaccttgacttcatgaacttacaagctagtagaatctacgtgtgcatataaattcctataatacacaagaaatagtaagtgctataagagaaaaatgctaatttgaacacaggagaatttaattcagactagaagatctgggtagccttaatggtagaagtcgccatgttggagcttggtcttgacaatgtttttccttcaaataagatgaaaactgtggaagtgcactgcatacttatttagccaaaagttactacttacagatatctttgcataaagtaacccacacagtggtaaaacattttcatttgggggagcatattggattttgcctggttaagaggaggaggatatttcaggtagagggaatggattgaaagcatagggcatgttttagcaaggagttgaatgttgctgtaactgggctcaagggagacagggtggctggcatttgaagtcaagggttcaggctatttgacacttttaagagactaagtgacagtggaggaggcaggcaggtcataacaggcagttattttcttttctcttctttctcccttgttatgttacttcctttctcttttctttttcccatagcagaatgcaatgaaaaagaagacaggatagggagtctgaagacacaaaatcaaggcatagttctgatactgaactgctgtatgtttggaaacttaattcaattaaagctgggggcagggagcagttttctaaaactacacaaatgcccttctccctgtaaatgttttttgttagctgctccaaaaggaatacctccttctagctgctatcaccctctcacaaggatcactgctatagtgtcagataaatacacccttaggcatgttggttgagaatcactgaacaaaatgatctctaagtgtcccctctttccaaccaccccagcctgctgtccaccaccttgccacattatctgattcttttcttattcccaactaagctttcagtctaacagtagacttgtatatggggattgcttggtctttctggaggtgcacagggctacaaattcttgtcctggaggaaaactaaccatgagtggccacagaaaactgaaagacttgagcacctgctccacaggcagggaaggggataaaattactgggctgccactaacttgcaaaaataactcgggggctatcctggatgcaaaagcagcctgatcctttcaaagaacaattgtgagaaatgatgtgtgttgtggggagggcagagaacagagtgacagaattctaaattatagagctatccttcaaggcctaattctttagaactttctcagatatagtttggatgggagtgacagggtagggtagagaggggaagaagatgatcggtctaagattcatagtcttttttttaagctgacttactcttaagaaagttttaaattgcacacaaaggaaaatgcaccctccgcatgacgctctatgaagcctaattattggagcaaatgtttactgaattaattttagaaatacaataccaatgctgcctgtttcataatctaggggaagtattttcttctcaagccatgttcagcctgcaacaggaagccaattatcaccccagaacatttctcagtgaaaaatatgtcattccttcttaggacaattaaggcttaagcaggcttaagcccccatctcacagtgttttcttatttttaccatctaaatacctatcaatccaaaccaagatcaattccatttacataacctaaagatgtcactaacatttggacaagggaaattttggaaaaggacaagatatcttttttgcttacttgaatgcccacattggcttttcctgaaatcagaggataataatggggctgctgagggaaaaatgcaggaaataggcagtggtactgattaaatgagagtaaattcagttttattactttcatgtaaactcagtaattctaactaagaactaacaaatgtagtccctttagaattcctaggaaagtgtttttcatcagtggaaggaaataatttctagttaccagatgtacgcactctgaagactggagctaggtcttactcaagtctcggtttctgctagaaattagcatattcatctacccttccatccaacatcacctgacacacagtaggcatccaatacatgtttgccgagtaaacatattggcatattatgtttgcaattgtctgctcttgagaatgcttccaaatggcttgcataaataggctaaatattgtcctgagagcatttttaaaaatgcgattagcaaactttttatttcttagagatgacaaatttttacagtcctaaataatatggatagaaatttaagatgttttccatgtgccaaaagaagaagacgttccatttccctttatagacatgagacagaactcttccagagctcattctgtgtaatcaaacactttcaagtggcaaccaaacattccaacgtgcctaagctatctgaatgtcatagcaaaagacagctggtgatacgatgttagaatgaccagaatttataccatattcacattccctttagcacataccagattccacagctctaagacaggtgtgttctgctaccctatttttccctcaaagagcacctggagcctgtctagaaaacagaccaagagctttactgccaaccactgtaggtgggatgactagattttctaattatagaattaggaaaacgtaatttgacatacgcacttgtacttttgggggcaatgggatagaacatgtgacactggggctgctctgaaaactccagaaagtgtggatttccatgcttaaaggaatgactagagaatctacaaaagggaagtaactttataaaacagacaatgtgaaagaacacagcacaaacagtgttaaaatacatgagaaaacatttataacacatttaacagagaaagcattaatttacatgacataaaaagaacccttacaagtccataatttaaaaaaaaagaaaaatgggcaaaggatatcacaaatgattgataaaagaaacacaaaggactagtaaacatttgaaaaatatgctcaaattcagtattcatcacaaaaatgcaaataaagcagtaaggagctatcattcctgacctgtcaaattggcaaaaatttataggattaatgatatcatgcactggcaagaagacaggaaatgactcaaataccagggttgagattctgacttggtgaagcctttgcagaagccattgtggtagtattcgtcatcaaaatgtacaaggcccttaacccttcaacccagcaaacttacttcttggagtctattctagagtaatacttgttcacgtgtacaaagcagcacgatcatggctgttcattgcagcactgtttgtggtggcagccaaaagacaggaataatttaagtatccatcaacaggaggatctcaatagtaaatttcccaacctctgatatggcccagcaggcacttattaaaaagagggagagaaagtaagggtagagattatctttgtggggaagtgactggaaaagggcacaggagtcttctgaggtgccagaaatctctgtgccatctttcaggtgcttgttatacgagtatgctgtttgtgaaagttcattggtgtacatatataatttgtgtacctttatgtgcttcaataataacatcttaaaataataaaacaaagatttgggagatcccatgtgttagtggaaagaggattatactaggaaggagttctgagtcccagctccttttggcctcaactagcttgggaccttggacaagtcacttaggctgaatcacagttgagatgactcacctgtaaaagtgggcataattataccctgcatagataagtgggccagatgattttaatatagtttttttcgtttctaggctccacaactcttcaagccctattagttccgaatgataaaccaccagtaagttttttggatctatctcctcttctccatccctatttccacaacactgactcaggtccatatatcacttccctgggctatttcaaaagtcttcaacctggtctccccagttctagttttgcctttttataatccatgataaccttctggttagagtatcttctgaaagtctagctcagatcaaatcacttccttcttcagaaatcttagaaagcagtggggcataatgcaaagtgcacaggtctcactgtcatttaaaaacctgcgtttgaagagcctactggctgtctcatcttgtgcaatccagtgagcctctgaacctcacttacctcatatgcaagatgagagtactaataggaccttcttcacagggttatggtgaaaagactttcacttactagtgtgccaagtcctaagttacagtaaacatcagttaggggcccagaaggaaggcagagtaaagttccttagctaccacttcttcacttgctccaatcaaggcagaaaatacttctgggcagtctgagctgcaagacaaagctttctactcgactgactggctgtttgacaggagggcaaaaagtgaaaggcatctcccgctttgtaggcaatgccactgagagtgtggtgctttgtagcaaaggatgacagtcttaactgatggcaagctgcagcctggaagatctgtagtcctctctgcacacctaatgtggtaataactgcttaacagagacctcacacaaaatcaagagaagctgaaagcttgtggttgccttgctaatgtaatttaggatgcattagtcaatgtttctcaggctgttcatcctagatcagggtaattatggaggggaataaaaaaggccagattagaaaacagcttgccagcagaaccactgtatttgtatgaggtgatatgtgaatcagcatctgaaaacggtatgtagttatgacttgttgcctgctcagactttatgtcaagctctgaagcaaattcagcacttagtgttcatctcagagaaaaagcctggtcactgtggtttgtcacacaagcctcttgccagataaaaaggccactcatgctgggaatgcctctcacattacaagatttacacaatctccaggaactaatcttgggcaaagatgggatgttttcaacttgatctcttatctttccaataaactacaccaagcatcttctacgttttacctcctccccacgaagcttccttgaccgaccagaagaaagcagatggcttctttagctgcaccctaatttcacataaaatttcatgaaaatgcctccactcttcatcccaattgtgcacttgcactcaatcttctacctggcatagtgcctagtacgtaaaagacactcagtaaatatttgctcttatttactgagtgttcactacgacctgtcactctttcatagcattcagcataattgcaaataattgttagcgtagttatttgcttaatgactgtcttctttactagactgttagcatctcaaggccagaattggattctgtctcattcacagcttattgtggtaacttaaagcctaccactatgcctcacacttattaagactaaataaatattcactgaataaaagaaaaccaggcactaagcactatttattcgttttctcactgaatcctaaaacaaccctgtgcacttggtattattacctctattttgtaggtaaagaaactaggcttcaagagctgcaataacttgcctaaagtcagggccaggattctgaacacgtgctcttaacaactgttactctgcctccctctttcaaatctgcttatactatttattagttgtcgcctggaaaaatttcctatgttttccaagcctcaggtttttaaaaaatctgtaaagaagtggggaatggtgtctatcttacagatttcttgggaagtttgcttgagtttatacatgtaaagcacttggtcatagcggttggcatacaatcaatatttaataaaagctactgctgctgttatagtttctattgaatcaaatatgcagaagaatgtggctggagatagggaatgccacctgctgaaacctgccccctctcccaaaattagtacactctgtttctgcagttgagtatctctctaatggttttgtgtaccactctcatcacctcaccatattctacaaaacagcttgaacactaaagatgcttttgcttaaaattcaaatgcagaataagcaaaatattttaaaattaattatattacacaagcaattgctcaatgtgaaatactacaatctacatgacttaaattgaatagctcacattatggaggatatggaagattggaaaaaaatcaagactgtccccttagcacacaaaaagagggaatttcatcattatggatttttatttctgtagataatcaatggacatcaggaaatagagcagagaaagcagagaaagagaaaattgcaaattaggtggtctcttctttctgtgttgagatacctagagaggtcaacatttacacaaccactttaccatcttttggtctactctgttactgtcacttctgtcatttcagttcctaatagaggactctggacacactgtgtcacagaatactacaaatgtccagcattctgaatcacagtggcctaggtacatgtataatagtcctttgatacagtataattagctgcactgcttctcaagtgtggctgcatattggaatcctctggggtgctctgaaatagcatagacacctggccccattttcattttgatttaattgattccagacactgattttggagctatattgcctgggtttgaatctcacctcctctacttactattgggacacattactatttggacaaattagtatctgtgtttgtttccttatctgtaaagtgaggataataactgtgcttacctgatagggttgctgtgaaaatcaaataatatatttgaaatacatagtgtcaggcacacagtaggtgttccataggtattagctattagtagtagtagtaaaacggtattttaattgttatactttggtgttgtggaagagaagggaaagcttgtagagtttgcaaccacatgtgacaatgctgaaatggcagcagaagtattctgtgtttcaaatttataaaaatgaaatctcttcattgtaaggtactacttcaacaatagaggatatgagtttgattccatttggaatgtctcaattttgtacatgaagaagtaaaatataaatgtaacacatgtgtactagaacaaccctatttacctataccacacaatggactgtcattgccagtttcccctggtataaaaaaatcctaaggaaaagactttgaaaaatcaaaatcatgctaatcttaaacagtgatattggggattgtaggggtttggttcttgtccccacttgttgccattctgtggcgaagaagaaatttccattgtgtttgtggagggggacacagagtaccataaaaacttctctgggctttcacccctgcttgttctttggcacaggagcaagattgacttatctgattatcatgcctgtaatcccagcactttgggaggacaaggcgcgtggatggcttgagctaggagttccagaccaggctgggcaacctggcgaaaccccgtctctacaaaaaatacaaaaattagccaggcatagaggcatggcctgtagtcccagctacttggggtgctggggcaggagggttgcttgagacctggagttcaaggctgcagtgacctgagacagcaccactgcactccagcctgggtgacagagggagaccctgtctcaaaaaaaaaaatactaatattataaaaaaataaaaataagtacttattcatggcctatcctgtgcattctggctctcaggtctaaatgccctccaactcttttatgagtgagtagagcctagtcagggcacaggcaccatcttctagaggtagacctacaggcccattttgctcttcatttctagcttccactgaagtgtgacacaggccatcactctcaagggcgctgggacggtaaatggtctgctctgaaggctcactcatctccacaggtgagtatcaaggaatacatttgaagctagaggtggtaggaagtctcattaggccttagacacaagccatgttcttcaacataattttatctataataaagtcgatgccatattttgttcctcctgaggtgttttgtgttttttttttctcagtttgattcagaactggaaaaagaaaaccagtgtggttatttcatgctcttacaccataacaagcagagcagtaaccataaaagtattatctgactgcttttaagttgctttccccattaaacaaatttggaaactgaggcttagaaatggcttctgtggtccacctaaggccaaaagtctaataataagtgtcaaattcagtactaaaagcacagacttcagtatagttttcactacatgtctgagtgtgctcctttcccttattaaggctagcgaggaccttacaggtcccaaggacaaaaatgacatttgctttctgcactttactaagctaggaggagatgaaaacaacctctcaaaatgcaagaatcctcttactctgaaattcagttttactcacctaaaactgattttttttccagacaaatctttgcccaataatcacgaaattgaaagagattctctagacgaagttatacaacaaagtttaaatcactgatatagtttaggtatttgttcctgcccaaatctcatgctgaattataatccccaatgttggaggtggggcctggtgagaggtgttttggtcatgggggaagatccctcatggcttgatgctgtccttgtgatagtgagttcttatgaaatctggttgttgtaaagtgtggcgtctccccctccactctctctcttgctcctgctttcgccatgtgacatgcctgcttcccctttgagttctgccatgagtaaaagcttcctaaggcctccccagaagctgagcagatgccagtaccatgcttcctataaagtctgccgaaccgtgagacaattaaacctcttttctttataaattacccagtctcaggtatttctttatagcaatgaaagaatggcctaacacaaccacagacaaaacataagtataaaatgttttcctgcttgaatggagtggccttaagggtaggctgggatggaggacacaaactgtcccttaccaagtaatcaggtgtcacaaaaagattcttctgtaatttgctgagttgcccgagttctgctctaagaaagcaattccttcataggtatttcccagtctcaaactcttttctgtcttgagaacaaagtgccttcccctgtgcagcagccaaaacagatacggggcctcccataccaccaggtgagcttgtgacaaatcacgtagtactattagcatgagagaagttagcatttccaggttacagatacactttcacagtaaaaatgaatcaattacatgccacagtcctagccaatttgaaatgattatatgggtctggtaataactagttctcattctgccatgaattaaccatgtgaccttagataaatcccttctctgggtctcagtttcttcatttataaaaatgatggagtttggccaggcatgatggctcatgcctgtaatctcagcactttgggaggctgaggcgggtggatcttttgagcccaggagttcgagaccagcctgggcaacgtggagaaaccctgtctctattaaaaataccaaaattatccaggtgtggtggtgcacatttgtagttccagctactcggggggagctgaggcaagagaatcacctgaggcttgggaggtgagctgtgatagagccactgcactccagcctgggtgacagagtgagactctctctctctcaaaaaaaaaaaaaaaatgctggagttagttgaggttgtctccaactctaaaacactagacttaaacatctaccactagcctctatattaccaacgtatcaggctacttacacttcatgtctgctgagagaattcctaatgacttaagtacaatgaagtcacaaaatcattccaaagctatttcaatgattcgggcaacttaagagagatgtatttccatttttctatcctgcctcttttgtgccaccctgtctgccctcccctggacagtccttgaaaatgaaaacttcacactggatttcttctatcagacctgagaaagaaagtaggcttacttttttgatcctccagttttcaagataatggttttatttcttgaagctgtaatcagatgaaaatgtccaaaggactaaagaaactgagtagggctattagtctaccctttttcttattttaattctatctgagggaacaataggctcttcttgcctttggcaagataataattcagctgacatgctagaaataccacacaccaagatataaaatggtggcattttctctctttaaaaacaatcaacgctttcatctgtggacttcaaagtacacatgaaataaaaagtctcagtcctgtgagtctgaggtaaatcaaaaggctataagtgtcatagaaaagtttcctggttcgtagccctcctttcaggtaagaaaggaaacaaaagtactctcaagcagatgagtgttcatctcctttttatatttctcttccaagtgagcctgaacaagttttctgataacccattctgataatagttcttctttatggctgaccaaatttcttcttgctgctctacaggcccactttctcctattaatctagccttgtagtgctgtaattgttcactgtctttatattgtcaagtatcattttgatttccagaatttctaaaggaaagctgagaatggagttgggaggtctatgatcaagactggatactctctggaggtccttatttaattataacactcctggtgatgctagtctaccttagataaagttatttctcttctctagtgattagcacctcatgtgtaaaacgcaatgagtatgagaatacattaagagaaagaaacaatcaccataccaatacaaattattattgattttgaagggtctttctggagatcttgaacttttgtgattaaataattattgcaaatgaaaactggctgaagatccctcttttcacactgagtcattcgttattcacatgaacttcggcaatactacttttgacgcatttaaggacaaatctatctttcaacccaggcttatagagaaaagacaatggaaataggactctgcccacacctggatgctcactttggtattgtaattattcctgggtagtttcccactcttccagagagctgacaccttctttgaatattattgtaccatgatgttgcttaaaacaatgcattcgattttagtcatcatccagttggccttgttgactcatggttttttccactttagtggaagtatttcatgaaagagttggtatttctgcttctacaaatccagatggctctcaaaccaggaggcagttggcaactttgagaaacgaacttggcattgtgattttacatgggtttaacaatcttctactcttttgctatagagtaccatctgaataaatggatttgctgccatcttagacaatttgtacagctacagcatcaccaaggaaacatttccatggggaaaaggtaaaatttaagaggaaacacactctgaagaattctgagctcatcttataaaagctacaaagcaaccagatccacaaagaaagattatgtggtcaaatatggcagtaatgtctaatcctgattactggtctacttcatagttgaggcaggacatttaaactctacctatcagtttcccttgggcacttaagaaatctcagctgtaataaggcaaggattccattagggccaggtatttttttttttcacaagcacccagatttgatttgtgcctgttctaaggatgtaatctcacaaatgtctgagtagcctttagggacaagtgaagctgtcagttggtcaaattcagatacaaaggcagagtttcgtgcaaagctctatcctgaaaataacaagaaaataatagggaatataaaggcatagagaaagcaattattcaatcaaatatgtgatcaagcaacaaatatttctggagcatctattttgtgtaagacaccatatctctgctaagagagttggggcccttccaacaggggagttataactgagttgaaaagctaaggcatatatatatatacacaaactcataagcaatagttcaaggtggtccacaatcagtgtcaagtgattgatatgaatttaatgaccgatatatttcagaggtacaagagaacatttctaattaagatgatccagaaggcttcttatagagggtaggacttgtactaggcactgacagttggataagactttgacaagtgaaagaagaaggggagcatgctgggaaagggaaatgaatggtatgagcacggtggtgaggtaggtaagcacagtgtcttcagagaaaagtagtggatcggtgtggctgaaatagaagacttgttttggggagtagcagaaaaaaaagaaagctgaaaagaggaaccatgagatctgagtttgaagggatcctcaagattatcatatccaaggcctgctcctcttattcttacctatttatttccacataaacacagctttccctagtctgcaccaatgttttacatacattttagtggtggttctagattcctaataactttagacacagtaacttcagcatagtagttagaaatagactttggagttagaggcctgggtaaaccacttgctagacattcaactttgggtaagtttatcctttatttcttcatctagaaatgtgggtaatagtatacttacagtcgagggatgaagaaaatgagaaagaaggcttgaaggagacagtaaaggaagaatctgcaaagtgtattaccaaggaaagcaaaagtagagaaaatacaaagaagggggcattgttaatagcatcaaatgaaacaaagagttcaaggtggttgcgacctgccaaaaggccactgactttgacaatctgaaggtcacaggtgacctttaagaaatcagttttagtacaaaaggaaagaggcagtttgtagaaaatggaagaggtaggagggttgggaaagggaggaaaaaagattgtgtagtgtggaactggatctgcaagcaaatatccctccctcgtttgcagggaaggagagggagagagatggctttgactcagtggagttacagggccgagtgatgcaatgactggacatgcagcttggaaatgaaatggtcggtagctcctttgggaacttccaactctagctttcctccttgccacagtgcagggaatgatgacaaaggaagagggaagttgctactcatgaaatatcttccctcttccttttgtctagtactgcagaggaacaaaataatattataaagctgtctgcctatttacaatatcacaagattgctgctgaacaattataaaattgttcaagtataaattatacaattataaaagactccttgtatagtaaaatctcattaatttggactacactaatttggaatttgtggtaatttaacctgggttggagttacctttgtcctactaacaaagaaaaggttctctaagcaaatattgaacaagatttcaagggagctaatttagcctgccaggggcttatttcacttattttaaagaacatactgttttttaagaacttcagcatattcattatttgaatgcaaattgttctgctaattatagattagcataatctactgttaaaatcctatatgtgcaagttactttgctctcactgaatgtgctcattagaaataaaactgcaattctttaaagttaattcacaattcagattaatacatacttcctttccccaccctcatgagttaactgcagttcaggaggtattaccctaaactcacacatcacttaacatcacttaacatgaatacaatggaaaaactagtaggtgatcataaaagtctcagagccagaagagatgtcttaaagttgatgccctaaattctgtgcactctatccgtggcaggttccacttagagctgatttaacttttacttatactaatctggcacatcagcttggagagatggctgggttttgttgttgttgttgttgttgttgttcttaattcagtagaaggagaaaaacggctgctacatgaagggacgatgagaggaataaaaagtgactgtaggcagcagaaaggagacaggacatgtgtaaaatgtggctataataactaaaagaccaccgcagcgtagaacaatttagtgtagaggtaaaaaacctatactttttagtaaacccttaaaaatttaaaagtattagagtgccgtacaataactaatgactggaattacgcccctaaatgatcaagcaaagtttaaattatattgaatacatgtctttaaaagacagatgagtttatacacatacacacatatggtttatactcataatgcttaacctaaaaatgtgaaacacgttgatgatttaaaacatgaaatttataatatcatataataatgctaataaaatagtaacgtttattaagtgattactgtatgcagacaccatgctaagcactttacctacatcatttcaactaactgtcataacaaatcctaagacataggctttagtatcacttttactttacagctgaagaaagtgactctcagagaggttaagcaaataactccaggccacagaaagagataaaaccaggattagaactcaggccagttccttggctatacaccatgcctttccatgctccagaaaacagagctctctaagaatcactcatttcttgagggttccatgtaactaatgttttactgtattttcattttccaaactcatatttaacaaatatcttgatttataagcagagatctatgatctaagagtcagatatgatacatttgtaaacatgttccatttcacaagctgaaagtaaaaagtaataataaaaaacaaaacaaagaaaaaatgatgaacatgtctgttatgcccatccccgaatctcagatcagtttctatatactacagattctacttccaaatgaataaccatgcaacaaagacataaaattgtaaaatatcaaatgatcagttaagatgtggctctcctatggttttctcactccttttggaaaaaaaaaaaaagaaacattaagatgagaataggccaatgggacatgagggattggggtaggagaaattgcaagggaggctaaaagctccattgggctgttatagagggtttagaagaatctgtttgccaactgttctaagagaattataagggcataaaacatatgtaggcatagtgggtattgaggggaacaggggtagaggtggggagatgcaaatatatgcagctatctgtattagaagtaaaagtgaggatggcctgccacatgtacatacaaagacaaatgcacagtgaaaccattcactcatgcaattccttctacctaaatcgatgctctttactcatctcttgtctcaagcctacccattcttcaaggatcagctaaaaatggcacttctgccatgaagtgttctataatccctaaggcagaattaaactcttcctcatttgtgctctcatcggtttttcaccctttacacacttgccacagcactgatgatactctatctaattatcacagttattcgtgtatgtgcttttccctccttcaatcccataatgagttccatgaggacaggggactctttctcatttatttagttcctacaagctctagcatagtatgtgacctgccacatactaggctctgggaaaatgttgactctggtactggcttaagacagtgcattatcacctagcttacctgaaggagtatttgttctctttcttttcttgcttgattcccctccattctcaatgaggccttctgtgaccagagggccactggcactaccaaactgcaggggctcgttgttgttagcagggtcaaagggcagctggttcaatcctaaagaagaaaaagaaagccaaagtccagactccattaaggactgggattgtctccagattttattatatgagccactagtggaaaaccttttaaatcttaaaagcctaggagaaacaggtgaattccttaaagacagttgccttctgtaatttttacagatcttttcggtaagtacaaaattaaaatataagactgtggctctgtcatttgtaagatccctcctgtttctgcggcaacttaacatttttagtcataagctagcaactgataggtccctcattaaatgtggctatggttggacccactgttccttgtaaaaagtttggctttgcattccttggattatctcctgacattttaccattctttcattacaaggtatgttgatctcatgcagatataatcatcagactatcctgtgtcaaagtcacttccaatagtaatataggggtctctaaaatcagaaaaccataactccatggcaaatgagaaaaggaaacaaatatatagaaattgcaagggggttatttagtagctggagcaatggggaattatgacctagatttcggtaatgttaatctcattctcttcaaataatattagaagcatggtcactttactcgtcactgctgcaccatataaaatggcaaaaggtattttctactctccaagtcttacatggttcaatcaggggcaagcagagacagagacagttcttactcctctggcagcagcacctggaatttcaagtgtttcaattaaacttcatgaaatgtgaaatcaaaagcttttttaaagcccaaagttaagacatctcctgtaagccttttctccactggttctctaatcctatcaaagggggggaaatcaggttggcctgatatagctcactctttttttttttttttttttgagatggtcccttgctctgttgcccaggttggagtgcagcagcatgatcttggctcactgcaacccccacctcccgggttcaagcgatcctcctgcctcagcccccctagtagctgggattataggcatgcaccaccatgcctggctaatttttgtatttttagtagagatgaggttttgccatgttggccaggctggtctcaaactccttacctcaggtgatccaccagcctcggcctcccaaagtgctgggattacaagcttgagccacggtgcgcagcccatagctcattctttaactcccaaattttctatggcccatagctgtacaattcttgaggtaatgttgtaaattgtcagttaaaaaaaaaaaaaccttgaaatccagtcagctaaaggtcaatcaagtttcaataaaatgaatgctaagattctaatgggctggcatggtggcttacacctgtaatctcagcactttgggaggccgaggcaggcagatcacctgaggtcaggagttcgagaccagcctgaccaacatggagaaaccccgtctgtactaaaaatacaaaataagccgggcgtggtggcacatgcctgtaatcccagctacttgggaggctgaggcaggagaatcgcttgcacccggtaggcagaggttgcagtgagccgagatcgtgccattgcactccagcctgggcaacaagagtgaaactccatctcaaaaaaaaaaaaaaaaagaaatgactttaaattattatttataataaagagtatcctcttgctaatgttttcagcccacataacaagtactgtttttcagcaatcagattccacttggatcacctccattaaatgtcttctggaacttgtcaaacattcttccttacatcatgtgagtaactaagtgaaagagtaaaacttgcttctggatcttaagcgaactgttcactgcatcatatacatgttctactaaatccctaccatgactagaactaaagaaacaaacatcaattgctatgtactaaaaaaaaattgagatcatgaccaagactatttaaaaagaagactagatgtttattccatttacaaatgaagattgttctcgtacctgattagtcccagagtcaaatatgattaatatactagtccaaaacttttcttggaatttctttctgaaatatactgatcaaaacaagttccatggaagacagaatggcatagtggaaagatcccgacagaccgggattcaaatcctggttatcctttactagctgataccttttggcaagtcatgtggtctctcttagtcttggtttcataatgtgtaaaagagagtgataacacacctaaggctgtggcaaagataaacacatacatatttatgagaattacattattctaagtaaattaaaacaaactttccccctataaacttgaaagctctcctaaaaaggaaacttccctctctccctccctcccacaattatattcttggtgcctagcaccataccttgagcgcccaaatgaattaatccttaattggatgggggtagatgactcattcttttaacccatgtaatgaaagacctgacagctgataatcaagaattaatgccacagcttaaaagttctgatgctgattatatcaacattacttaaaataattagattctaagtgcatctccatcatttgagtactatactacagaatggtaaaatgctgatgaaaaggaatgttcagggattaggaggttctgattaatgacggtgaaacagaaaaactttttttttttcttttattattattattattatactttaagttttagggtacatgtgcacattgtgcaggttagttacatatgtatacatgtgccatgctggtgcgctgcacccactaacgtgtcatctagcattaggtatatctcccaatgctatccctcccccctccccccaccccaccacagtccccagagtgtgatgttccccttcctgtgttcatgtgatctcattgttcaattcccacctatgagtgagaatatgcggtgtttggttttttgttcttgagatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcaagatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgaaacagaaaaactttttatttttgttttgcatttgataattttacagaataacatattagtccatttccctgacttattaagtagatgactgaggattttccggaggtttggagccacaatttgcaaaaggacattaataagagtacctaactcacaagactgctaaaaatattaaatgagattatatatgtagaacattcagcataacatctggcacatagtagatgttcaataagtattaactactactattataacattgaatttccatttttaatttctagttactgatgtgcaatgtgaggagattgttctgaatctgccctgatccaaggatgtaccctgctttcctcattgaaccttttcattcctgtttgtacctttttctaaaagttgaaggaatccaggggaaaaaaaaatctaatgagttaaaggtgttcagttatagacattttattataattatgcttgccctttctttaggcccatatggtaaccttagggatatagttattttattaattacatggatgtacagatttttggcaccaaattaagactgagatttcaagtactttctgtgtatccacctcatatatgatccagatatgtgaaaatcatgacaattcagtacaacatttcaggcctaattttttttatagagaaagatctcatatggaggggggacatctcactcagtaagctgactcgctgaacacaaacccatattttatatcatccaatacccaatacagtctccaaagatttgtagttcaagaggaaggatgaaagagacagcaaaatcctatgacaccagtgcttcctagctacttttactgttttgtttcattccttccataagacaggaccaaacaaaccaataaatcagtaaatcaataggtatttaaagggtgttttttgtgtcatgtatatgtgacccaggtcaaatgctattttaagtaaactagtcccattaaaatgattaaatactaaaaaagaaaaccaccactttaattccaagaattcttattgctgaaatttcaattatgacataaatataaaaatattggcaattaccatattgtaatcctcacccaaactacagaatttatctttaaatctcttatggaagcaatttctaccattttttctagacatgatgaaactgaaaaatattagatttggaagaaagttttgaggttatctagtttattcttctatttctatagaaattttatctatagaattcctgacaggcctaaatccaggggcactgcttcgcctgggactcattccttgctgggctcccaggcattcagcttgcttttaaaaactaccacctactctattttgggagttccttttatttccctaaaacagcttcttgcttatcttacctaaaatgaagacataggatgtataacttttaaaagtttctactgataatcactgtaagaaaaacaaatgacagagtaacagataactaacaaagtcagaaattgtccaaagtcttacgcattcctcacagtccttgcccttttattcctaagaataaatttaataaaacctcatacttcgttcatttgtttccctcacatctcatctcctccctccagcccacaaaatttacagtttgtccaaagggaagtacaaattattaaaataaagacaaatagataataaacactggtgttacagatttctactatttctgtatctcatgttcacaataaacaaatccatgtggtaacgtaatctcatctaaaaccaagttgactggtgtagacagctgaccagctgttatttcatgtcatgttgaaatgcagattatctgactccataacacgtatgaggctgctttagaaagtatgtatattgggaaagggtgggggtggggttccttgtagaatgacatttctcatctaatggaactagggggttaaacatctcagaatgaagtgtgatgctcagtgaatactccaatctgcaggtcaaggagttcacaagcaatgttatgtctgccatacagatgcaaatgattcgtgggctttgaggaaagcactaaagaattttcatgattcttgtgtgagaagatcaataatctctttgtgcccagctgctttaacagttactgtcacaattcactttacatagctgtccactatcaggtcaaattaggaccaaccttcatgatgcaatctaacacttttaatgattgccccaggttgtaataccaaaatgtgaccctgtgagtgaatgccactttttatctgcagctgtggctcagagactgtataaccctagcgaaaagaaacacaatgccaccctggattagttagctttaaaagaaaatggctaaaatcttgagaaatctgataaattcaaattaaggcaacaatctcaacacataaattaatgttgaaaaaatatcagtacttggcaataagaacagtctagctaatttgtctgtaaaacaagtttctataacctaattcttattttccaaatgacttcaatttaaaatcagatatgagattccatgttgggagatgagggtctccaaatttgttttcaattcaaaacttttggaaaaataagggattaagataatggccaggcccttaatgttctggcaggtgctgttgaaggatttatccatctctggagggccctcctcactttcattcacccctcctgcttcctcattctaggcctcaaaaccatatttgtagctctcactacccaaccattccacctgctacttctgagggaatatttacaatgtccaaaagagttggaccgcaatattactcttcagccacagggcttagcagccaagacaattgaacatttctcagtgccaggtcttaactgatgtcaaacaaatgaaacctactttgtcaatttcatgagttcaatattctaactggtttagctgaagcaagggtaattgtatgagttacaaataatgggtaagtaaaggtaatgaagaagaagtgagaaagaaaacggaaaagtccttttcggaagcactaaggggcttgcttgaatggtggtagacaaactttcagagcctaatttatctttaagtcaccattttcaaggtgggatacaggtcatagaccaattttcattggcagtgatccttcagcaacttttaatgactccccaaactacttggtcaagtcactaaagtctctcataaaaaggccgcatccatttcaggccttgtctcccactatgccccagcttatgctctaccctaatacttctcaaactttttaatgtggacatgtgttccctgaggatcttgtaaaaatgcagattctaatttagtaaatctgagttgtggtctgcttttataagttcccagatgatgctaatcctgctggtgtgggaatcacattttgagtcaaaagggctggcactccagcaaaatggaactacagcattcactgaatccatccagtactttcctacctccacacctttggctcacactgctcctccacctgcttcttaattttcaatgttcaaaatatcatccttcctttagggcttatctcagatgctatttccttcatggtgtctttccttattcacctctacccaaaccaatacatacacagcaacagagagaggggaactacccatcagggaaactactattcattggttgtttaggatgtgcttgtttacaaacattatccctttattttattttctaattattattcttattttacaacaaggaatgagaaacttacagagttgaagtaaatttcccaaggtcacacaaggaattcaggctttttgtttttcctttttgtggtgagcagggtctcactatgttgcccaggcaggtaactcctgggctcaagctatccttctgcctctgtctccctaagtgctgggattacaggcatgagtcgccgtacctggcctcaggatttttttattataaaatactattctggctgtccttgaatgttagcctatacttttcctgagccttttagagcatgccttgtgttacagttctttgggtattctgtcttagcctaccttcccttctgccttaccccactcccacttagtggtaaactccttgaggacagactttatgcctcagtcattttttagtctctcctcccccaagacgtggcgcagtgccttgtattatattgtaagcactccagaaatgagtattgaactgaactcagctacaatttgggatacagcatggatagtatctgacttacaatggttcaacttacgatttttcaactttatgatgtaaaagtgatagacattcagtagaaaccatacttctcttaccacgctgggcagcagtggtcagctgcggctctcagtgagtcacaaatttttgacttatgatattttcaattttcaacgcgcttatcagattgtaactacatcataagtcaaggtgtatctgtagttgtgtttcccatcccaggcaccagctgacctgctgctggagttgtcatgaaaggaagaaggaagtaaggtttatgggttccttcagcattcctggtatcttctgcatcttaggattcctgaagcctggggagtgatggtagacaatcacacactccactcctaatgtatctgcataatttcattctctctttctgaagggcaaaacagtccttccattgaccaagaccgttacctgagagaatactataaaagagatcccatatatggatcttctgttaatcgttctatgtacatcaggttacatgtcccatttacaaactacagttaagaaaaggcagtctctatccagtctaccattgatgggcatttaggttcattccatgtctttgatatgtggtacatatacaccatggaatactatgcagccataaaaaagaatgagatcatctcctttgcaggaacatggatggaggtagaggccattatccttagcaaactcacacaggaacagaaaaccaaatactgtatgttctcacttataagtggaagctaaatgatgagaacacatggacacacagaggggaacaacagatactggagcttacttgagggtggagggtggaaggagggagaggatcaagacaaataactaaagggtactatgcttaatacctgggtaatgaaataatctgtacaacaaaatcccatgacatgagtttacccctataacaaacctgcacatgtaccgctaaacttaaaagtttttaaaaaagaaaaggcaatctctggagatgtgctatgcaatacagtagccactagccatatgtagctctttaaattaattaaaatggaataaaatgaaaagttcaggccgggcacagtggctcacgcctgtaatcccagcactttgggaggccgaggtgggtggatcacgaggtcgggagttcgagaccagcctgaccaacatggtgaaaccccgtctctactaaaaatacaaaaatcagctgggcatggtggcacgcgcctgtaatcccagctactcaggaggctgaggcaggagaatcacttgaacccgggtggcggaggttgcagtgggctgagatcacaccactgcactctagcctgggctgacagagcaaggctccatctaaaaaaacaaaaaacaaaaaacaaaaccagaaagaaagaaaaaaagtgaaaagttcagttgctcagttgcactaatcacatttcaagtgctcaatagttacatgtagctagtggctgctgttttggacagcatatttatataacatttcaatcatcccagaaacttctgctggacagtgctgctctagagtcagatctgcattcaaagccacatctgcaacttactaggtgtgccacttactaagtgtgccacttacaaggtgtataaaacaggtcacttgatctctctcagactgtttctgcattgtaaaatggggatgataatgccccccttacagcaaagtgaggaaaattaaataagagattgtatgtttaaggtgtagcacatgttggacactaaacaaatgtcaatgcccttctaacccaatggggggtttatataaatttgtctcaaaaatggaataagaacatttgagtagtgtggctccttcggcctccaggctacagtctatttacagcttggaagatgttagctttgcattcctcttctaacctactttttcttaataacacaaagccattaaagtaaatcatgaataaataatgcgggagtagtcagtgattgctctttgcttggattctgtttaggagaccatattcatcactaccttgaactgtccaacatgaaagaatcacattttcccctaacaatggaaatgtctcctcccaaatctttcaggaatgctctgttccatctgggtgctgtactatcagaacactgctagcagtgatactacagctggactagagagagtatcatttctctctaaatccatattttcgtacactcataatgttctctgtgttttttctgtggggctgacatctcccaggcctggtaaagggtgaattattcgagaaaagtctgaactaaatctgttaaggtgtttgtgttccgtgagcagaaaagcaaaatacatatttccaacttcaagaagaagaacacttcaggacttttttcccttgtccaatttaaggcttgggaaacacagcaaaatcacattcctcattgaaaacaaagttcaaaaaaatgttgatttgatagaacagttcaaagtgacagatggtagatgggtgatctatcattttccttagaataaagtctgtctggcagtcttcagaggaactgagaagagaaagccttattttgttgtagtttagccctgggaacagttacagcagctaccctttctctccacatcttttggggtaggggattggaaagatggtgattcatcagtgtctgctttgagctggctctaggccatgctgtaattcctgttgaccaattttccacctgagtgacaggaaaagggcaggttcctagcacactgaccattaggttatctgttgagtacttccctgagaatgtgcccagaggtactctattatggttgtctctgtctaaataaaataaataattgcagatttcagagcctgaggacagagagttgttctagtattgaaattggagtctatcttgtcagatctgtaatgaggtcttcccttcaggctgattgatttcataaaactgaggcaattatcaaaagcaagcacagttctccctgcagaaaccacttcactggttttgaaaactagcttgtcagccagatctggtcaggagcctaggctgagccagctctttaagtaggaacagttactacacacagagaacaccaatttctgctaatagattattaagatgccagtaaataagttgtaaacaaggttcagcaaaataatttcacatgctgtgagtgaatgaaaattgaagttgctgtcaaataaatctgcatttcagtgtaagatgttttgaaggagaaagtgagagctggtcttttggtctttggagagttaattttatcagttaatgctagaaggatactggtatcctttaagactgatgcaccgcatgaataacatttgtatctttgctttgcccaaaatgtacacaccaatttcaccagatttcctttctttgtttattcagccttcattaactatttatccaatcactatgctacaattttaattatcttctaattaaccaatgatgagtttgtggtttagcattccctaaagatagaaccacataaatatggtcaatcttcatttacatattcaaaatttttatcctccctcctggctcccaccctattaattttgctatactgcgtcactaatgttctggaattatgctttctgcattcctaatcttttagccccatttgggctagtttttcaagaatgtatgagaaataaccctcgctgttggctatgaaattaaacacacaggagaaaacagagcttcctgtaatatgctaatgcatccttaaagatccatacttttcctataacaatttctcctaggagtatcaatacaaggtgttgacaactgattaactcctttagagaagtccctgcctaagctgaagtcaaacctaccactaggaaaaccagaatctgctccttgagaagacagcatgactgtaaagtaaaaagcctgcaaaaaaatcactaatctgtgtctgaaacaactcctaccattgctgttgtataaaaaaaaagtaggatcttaattttgctacagtctggattttaattgaggtattcaatacatatgggaataaacaaaccaataaattaatattgactgatagtctctctctttatttgtccaattcattcaaacaattctgggtgccttgacagtatgtaaggcttgagaattttaggatttaatatgatagttttttttcctcaagaagacaacaaaagaaagaaaggcagatacatacaaagaaaatctggcccaaattactgtaccagcttcatctcttgccaattcccctaagtaccctttgcttcattcatgccaaaattctcaaaattcctcaaacatgctaagccctgtcatgtctatgtgcttctgcacataccatctcctctgcttgacatataacttttcctttttccacctggagaacttttattcatccttcaaaactcggctcaaatgtcacctcttcagtgaagttttacctaacccccaaaagctctctccacaggagtacacagagccttatcagacgacttattgtaggatcttagagttcattctaatatgtgtgtgtgtgtgtatgtgtgtgttctgggtggggggctgtcaccatctgatttgtgccttagaaagaccactcctatggcatgatgaaggatgcactgaaggtgagaagacaccagaggcagagagaccagttagaagaaaaccataatgatacaatggagagatgacagtcgcatgaactcagacagtggcagtgggatgaaaaaaaatgaatggatttcagagatattcaggaaatataatcatctggatttcatgtataattggatctgggagttgaggagaagagaggagtctgagatgactccatgaaaaaattcttaagccacagtcctgaaaatcctgcaacatttgtgggtttcagtatgagaaaaagcacagtccaatagaagcatatccataaatccatgctcaaaaataaaactgcttccaatctctatttaccatggcataaaggctgccaggaaacagcagtaaatggcttacacttgacctttactaggtattcttaacaaagcttgtcaaaagatattaattcattcagaaaaaaagtataattgtctaagaggcagaataacatagtattgggataaagatggggaaaagcattttcataataggtctcagacttggtttattttgtctatagcattcactgacaaaagacaaaagtatttttgaaggtcagaaacacttaatagattcctttgctttctcctttcatccttctcccttccctcctcccaaacaactccttaaaattttattagaaaatcttaacattttaataacagtattctttttgttattatagtctgttggattaagttaacaattctccctttaacaatactcaaagaaagcctggaaaaattaatgctatgttgtttttctccctgccaaagaatatagcaatgtaattgtctcctggagaagaagcactctaatcatctttaactttaaagtaaattcatttcaggaagatgctctgtgacaaacaattgacagagcaaatcagggctcctagaagattgcaaagtgatggattgagttgaagagagtgccacagctgaattcatgaacattttcaacttaagagtgtctctgcaacaaaacagcactgtatgagagttaaaatcatgttacattacattgtgggaggtaggacttaaacactgcacagattcttaacacctaagagttctaggcactccagaggcaggaaaagtataagccaatttctctgattaaaaaatagagaaaccattgtaccaggcaaagtcagactgtaaaagcatagtaactttccaaaaaatgccttaaagaagttgagatcagaaaagaccaaaacactctctcaatccaattgatgtcactaggatcttggaatgggtctcaatgccaaggtattactcttatttggaagatcatttccactttcattcccttcctaattgaatctgtctccatcttccattgtgtttgttccattattattttttagaccctcccgccccgccctgacattaggcttggggaaacttatcctttggagaagatttggattagtaaatttacaggcttgacaaatttacaggctcagaatttcctggaaattggccacttgcctgagatgatgggggaaggagaaaatggaagagcaggtgaactaaggctcttgaaaacttgaccgagcagcttggcctcctgagcagatgcaatgatgaccatatagcagcagtgcagaaaagcaattctacttaaaggtcctttctttgggcttttaaaaggcaattgttttctttggcacacatgtgacccaaatctggttttctccaaagtaaacagaggcaaaaaaagggctcccatgttctgtgtgtgtgtgttgttgttgttgttttttaatcagcctacttgcttgccccaacccagggcccaacataatatatttgtcaggagtggccctggaggagatcaagactttaaggcagtgtgtcttatccctggctacatattaaattcaactggagcactgagaaaaaaaaagacaaaaacaaaacaaacagaaaacaatgcctggactctaccaccagaaattctcattaaattggtcagggtggaacctaagcatctagtttttaaaagccaccaggtggccaggcatggtggctcacgcctgtgataccagcactttgggaagccacagcaagatgatcccttgagtccaggacttccagactggcctgggcaacatagcaagacgtccatctctacaaaaagtaaaaaacaaacaaacaaaaatttaaaaagctaccaggtgattctaatgtgcagccagaattgagaaacacagttctaaatagttttctaatttaaagccagaaaatgagtattcgctgtccaaagtttatttttattttttaaagttcaaaccaggtaacacttagaaggtaagttaattaactctgtacctacaatctgtagggaaaggtattggttgtgtggtataagtacgttagacttaaacttgtccaatttatgatacttttatgaaaaatgagattctcttttggaaagaaagattagaagggttactggaaaaacaaaaagaactgaaatattggaaacaaatttagacaaagtataattacaggattaagttccttaccttagttctagaagaaccagataaaatacttcagaaatattgtgtctgttttcttattaatttccaggagaaaggttccaaactgcccttggggactggctttgaatctcataacccttgggactccaggccactcacccctgtcctcaagtaatcattcatttataccaatatgtgtacaatgtcatgaagaataccggaaagcactgcaactataacaccattggataaaaatcacactgaatgtggtttgccgatgtcacctgtcacctcagtaattccattgaactttagaaaggatctggtaaaatataaaaaatgcaaaggcacagttaagtgctgtgatggttaatattgagtgtcaacttgaatagattgaaggatacaaagtattgttcctgggtgtgtctgtaagggcgatgccaaaggagattaacatttgagttagtggactgggagaggcagacccacccttgatcttggtgggtgccatctaatcagctgctagtgcacctagaattaagcaggcaaaagaacatggaaggactagactggctgagtcttctggtctttatctttctcctgtactggatgcttcctgtccttgaacatcagactccaagttcttcagcttttaaactcttggacttatatcagtggtttgccaggagctctcaggcctttggccacagactgaaggctgcactgttgacttccctaacttttgaggttttgggactcagagtggcttccctgctcctcagcttgcagacggcccattgtgggacttcaccttgtaatcatgtgagtccatactccttaataaactcccctttatatatacatctaccctattagttctgtccctttagagaaccctgactaatacaagtgtagtggaagaacaggccataaagatgcaggctgtggtctctgctcttccatcaactcatagggtaaccttgggtgagtaattctttgtcagtttcctcagctgaaaaatgagttgaaacatgtgatctgccagctctgaatttaagataaagaaagaaaagcttagatggaagacatccataaaagcatgaaataaaactcagtaattaataggggcagaaaaggagagcagggagaacagggagagccctggaaggatgctttcctagtaccacctacacaaaacttatttagcaggcagtaaatgatttaatagtagtacagttaaggcacccccccaaaaaattaaagtacttctgatgctgctcaaaaaaaaagcctttttaagaattttgctaattataaaccagaacatgtaaggaagcacagaacagtttttttttaatgatgtttaaataccaatatatcttctaagtaacttgccatcaattaatattatttacggaacaagcattatgaaactcagaagaagagtctaacgctgaaatgctaaaagtatgcccagtatggtaggaataaattaccctaattgaccaaagctacgctcacatgtgagacatttcaaaacacactgacataatgacaaaaattcctgtctctctctgccaatgttataggaattgttattaaagccaagcatggtagttgtgtacacataaaagcaagcaaaaattataatctagaggtttttaaatttaatcttttttatttattagtattgttatacagcaatgagtagtcaaaaaaaaaaaaaaaactaatcagcgtgcattatgcaacaatcagagaaaatactcctaatcctctgtcattctttttccttggcccctgggtactcattaaaggttaatttatttaaatctcttcaacattcatttcaatctactttaataaactaatgaatctttggaactttgcctaatcagcttatgttttctattttaatacatctacaaaatgtctttttttttaagctccttcttaataattgtcttcccttttggagatagaattgtgcttcagtgacaacctgatttgtacatttggtgacacatttacaacctcatccagcacacagggaatagctgtggcttgcttattgttcttaaacatagttacattttagaggatagtgaattgatttgtgtttagtaggataataatcctccaaattgaaatggtcattttacaatttagtaagagtgacaattacagtaaagcaaagcttctaataactttggtgcttgtcaaatgctatgagggtctatcaatgaaacaactccattctggttattgtaaaccagagcaatgtatagtatataccatttggattggcaaatataagtgaagtctggagatgtcttcaaatgaatagtacaatcaaaatggcgtataaaatggttccttacaatctatccaatcactatgttcaacacattttgtttaatggcaactttgaggaatctttcacataactatctttaagttgaatattcttacggtggtggccaatggtcagggactgcacgccaccctctacaccagaatgccagaaaccaaagtcttggcgtgctagcacattatttctaactactgccttaacaatatctgacatcatcctagaataacacggcttagcaagtgcttccacaatatccttatggtgggggaagggggaaggtattaatgttgttggcttgtaaataaggaaattgcagctcagagaagcttctgtatttccaaaaggttataatgtcaatatgtggaggagctggaatccagatttttgggctacaaatctttcctcctgtaccatgttgcctgcagagttgtgttcggataaatgtttttactgatccatggctcaccactgattaaagaaaaagtgtaaatgttacctttaagatgtcctgatgaggaacaaataaaattaattaaaaatatattatgacaaattattcaatataacataacttcataataccgtaattcatttggagcataactttacacaaaagagatgaaattcttaattttcagttttattttctatacaaattaataaaaataataaacttattcctcacccatgatctgaatttcgggtaaatttctaatggaagtagatacattgtcaaatgttttcaagttatcacctccgattttccaaatagaaactccaagaattacctttcagatttcattgttcattcattacacatctctctacccattcattcattcattcatccaatcatccaaatgacatttacggaatgtctactttgaggcaagcaaaaagtcaaaggtagactctacctgaagctcttgctgctgctttacttccctagactatgaactccttgaagacaggggatcctgttattctacacagaatataatcagttctatttgcagaaaatcacttaaatacttttttgacagtgagatttctggctccccctgccgcccacatgcccctccagacatatgggagttagaggaagaaatagcagagtctgcttatcaagtctgacctttggataatgactatagttctcccatctgagcttgctgctgttctgccttgtggtcaacaaaatgatttggctcaaaatggcaattcatctgttgctgcttcccagatatcctctagcaagccacattattttttttaaaatggttgcttctgcccttcggcatagaggtgaactgtatcaccaaatatattgtcttgcttgatacagtgagaagctggggtttacagaaaagatgcagataaacatgaagcagccgcgaaagaagaaacattcgtttagtgctatgactaaacaaatgcttgactttattattttaacaacaataatttatattcagagactgctattatcctttcaactttgcttcacatccacctcacagctactttgtgaggtgaccagagaaggcattattacaaagttaaaatacggaattctaaagctcagagacgctaaagtgacttgtttaaagttccacagcaagccagtggcagagtttggtctcccaactaacactccagggatcaggcttctctattaggggtcctagtcaacaggagagttgcatttttaataattactaggagccatgaagaactaatccattgtttcagtttgtactattgcctagttaattatttagaaatgatttattaaaaacaagaagtgaggaaaccatcatgctaagcaggcaattctggacaagagacttctttcaagcaaactgaacattgattaagctcaaaaagttagtatttaaataaacaaaggcaatggtaaaaatattttgtctgtattagaattccttgtagttatgcaaggatgaagcccgttatgccatgatacattttttattcacaaataatgaaggcatgaatgagtattacttatggaacatttctgcagtttctagactccttctaaaatgtaagaatatgggctttatgcatatttggtgcaaaatatttgttggatcatgtaatatttttaaaagtgaataatttataaaatcatagagggtcttctgatttttattatcatttaatatttaattctacaaaacagaattaaatactttgttttgaaaatagtttattaaacacagttgcatttcttcatctttctaggcctcatcttcaagattatgtgggattttattaactgatttttctaagcctctggcttctttcttcctcactgtaagtgaaccacaggctatattacacacatatattttgttaaaatacatgttacttccattgcttcctggaccaccacaaaagagagcccttagtgatccaagtcaattcacccatatttaaaaccttttacatttcaaaaacatgtattataacatgattagatctgtactttacaaataagccagaaagtgacatatgtggcttaattaccaaccccaaataattagtgttggagcaagaaaatgaattaaatggaacacagcccagtcatcctagcaaaagggattacagataggagctggaataactttgggagaagccaaacatatataagaaggttaatgaattaaaaagttgttataggtaattcaaaagaaaaagaaaaatgctgactactaccaaaaaattccacagcatattactgaaactgccacatcaaatactttaacatacccctccctagggacggatagaagtttgcttggtatagtgtattttctagcataacattgtgataaaaggatctgaaaataaaaagaaatgaattgtatttttttccaaaagctatacaatgaattcaccttttcacagaggatagagatcatgaagaaaagtgaaattcatatggaccccaaacctctcattttggcccatagtttctgcctccttccccatcagaatctccaccagagcactaacaggtagcaaaattggctgatagaagcatcattctcctattccttccctgcccaccctctggtaaaagaattaatgagcagtaaaattaccaaaagtgaggcagcagaatggagaataaagaataccaagggtatggataacctacaaaccagataatgagctcctgaataatcaagacttgacttaaacctcaaacctctaaccttctggcttagacccatcattctatacttatatttagtgtcttaaacacagaactgccacagaattgcagtttgtctctaagtccttgtttataggaaatggggggcaagaagtgatgtctaaactttggcactttgaacactgttagtagcctctcttgacactccattatttccctcgtcttgggcacccaaagatgttattaacctttgtaggagtcctgaacattataagaggtagttgacaattgcactagtatctcttcttccctctcaatgcagataccagccttcagctgttccatcacattcacctaaaaggcttctctttggtttttctttaaaactttcttccttctcttccttcccattacttaatgtagtggggccactgcacaaaaatactctttgtcccctaccactaaaaaggtgatcctacttttagaattcacgtcaatttttcacaagcttcctgttataactattttatccagatccagatacatttctcaactcaattttctgaatcctggtatcttccttggtgcataagccattaatatctcaattcgcagagatctcacacttcctggtaaaactttgcccattccacttaactatggtctgaatgcttgtgttccctgttacccaaaattcataggttgaaacctaatccccaagggtgatgttagtaagacatggggtgtttgaggggtgattaggttgacatcccacatgaatgggattagtgtccttatgaaaggggcctgagggagtttgtcccttccaccatatgaggacacatacaaggtaccatacatgaggcagaaagccctcaccagatgccagatctgctggcactttcatcttggacttctcagcttctaaactgtatgcaataaatttctgtttataaactactcagtattttgttatagcagcccgaacagactaaaacaccatcacagtgatggtttcaaggcagcttttggacttcaaaactgcttttccatattttcagaaatgttctttcaacaaataatgccaagaataaaggaaaaagggttaccaagtccggaagaacatttaagctgaatgtcgtggaacggcagggaataacagtccaggattcttaaattagagaaataaattcctagggaaaatgtctgagacagtatcagtaacaaagtattccttgtgaccatgccacactggctgcccattctacgctctgcctgtgttcctttttgttttaaaaattgctttcgagccatgtgtaagtacagtttctttttcctaagctaatggcatcttgtctgctcaacactcaccctcacccctggcacaatcatgggtacacatgcacatttacacaccaccatatgtcatatccatagacactcaatacatgctgggacacattttacaatggtcctctcgctaccttgccctggtatcaactcgatctctttctatcacttattctcacttcattagaggcatggaactgaggcagacatagtgaatggagttactgtctcctttatttaggaaaaaatgtcaatgtcagaagcaaagtttgactctgtgatggcaatgattgttcctgctcgcagctgaagaggatgagaggaaacccagattggaagtatttattcccaaggctttactataaggaaacaagtaattttatcagaaacaagtaatccataatttgctgtacctcaactgcagtggtatgctcaactagtagagttcacatagaaatacttggatctgtttgcaggagattgcttctaccagactgggcaaggtgtggtctcagagtgcattatcatttaaacaaaggatgctatgaatcacagatgacagaaccagaaaaacgcttgctctagtgtacaaagtttggctgatacttaacctttgctaggggaaaaggaaaaaattgcaggctgctacaccggcagcctagaacacctttttaactacattcaagccttttactgttacagaacattattactgttaatactgccatgtgtgactgagaatttgtaccactgacttactgaaaaagcatcttctacttaacaaattcaaataaatttaattctatgtactagcagaagtaattaaaagcaaatgaataaggactgcataactgcataaatatttccataaattcttgcacaaaagaaggataatgagtggacaatagaatgctaaaatattaacaatgcatcataagaatttaaaaaaaaatttttttccaaatcagcaagatgtactaaaatgtaacttttatcattattagagcttaagttctccttctagaattaccactgactcactaagggctttgtgctaatcattcaatcagatttcacattcatgatatttattctgaaacagcctaatggggctcaaggactaaaataacctcattaattagattccctcacatggagtccaagatgaaaactatcaacaccaaatagcactctacagttacaaagatgtttcatatcatttcatatttacaaaggtatttcatatcatttcatgtttaatttttataactctgggggttaaagtaggtattattattactttcttaaaaaatgagaaaactgaggtttaaaaaggttaattggcctgatagagttcattaagtgttaaactggtctcaggactccaattttagtgttctagcacatagtacagtgcctaacacatatgggtattcaattagcatttgttgaattgagtgaatgaatatagcatgctacttctcctaactacacttgacctaattttactcatttgcaaacagccctatagttgcattccaaagtagttgataaggtcatttactttccaataaggaagcaaaatgccactgtgaaaataaatttagccatctattttggtgacataaggcccatgagctgaaagaataagatattcaatgtccagctgttataaagtttggaaaaaagttggtaaaaatattcgtatggttgctttaaaatgatgaactgattatcactattattttgttggggagggacctttcagtaaggttgcatggaaaagcagattaaaattgggaaaggcatttgagttcccaacatgaaaatcaacaatgcctcttgttatgcctttcattcacagacagagaaaaagaagtttcagagttggcagggaccttggcagtcacctagtctaactgctgtctcttcctcccctccactgctgccattttactagaagtcacagctaattaatggcagatccagcactagaccccagtcttcttactggcaggactcctcatggaagcagttggggacttatattctctctataggtgccatctaaaattattcattttagtctaaagtccttccttaaccaaggtgagtaccatatagccctgcttgaaaatataggattcccttacagtacagcttaagtggcaataggttgtgttatggttaaatgcttctctggccttttcaaacaaccagaatagtagactaagaagggctctggagtcaaactgtctagcatgacaatcctgccctgccacttactgactgtgcagctttggaagaaaattaactcctcgaacattgatttctttgtccgtaaatgaggatattatctacttcacagagctttgtggaacttatatgaaacaattcaagcaaagcatagtcaacagataacctgatacatagcaaaaatactcagtaaaaatgagttgacttttactcattcttccttacttgtagttgccctagatacctgagcttaaactgatcaaataaaccttggatgactttccttttattcaattaacatttattgagcaattactacatgctaggttcttgaaatacagcagtgaacaaaacagacaaaaatccaggccttcatggagctcacattctagtagcagacacagaaaataaacaaaataaataggtaaaatatatagtatgttggtgattaagtgctttgtccaaatacaggaagtacattaggtatgttagcaaaagctgtgacctcattttctaggaaacatttggtgtctcttaccttcctcacctgtttttttttagagctaagacaacaaaaactaagacttctttacatagccccttctaatcttgggatataaaggtaaatggcataaaatatggataggtgagttgtgtatgtgaatgggttagaaggtattactggtaattgaattattcagaaagcaagttccaatatttagccataaaactggaattaaaaatgtgtacaaaaataccaccaattaggttaaaaggagggcatatgcagcgttggaaagaaatttcaaaatctgtaacatctgtaaagctggcagagattgttactgattgtagcaggaaggggtagatcccaaactctggcaaacgtgatttgggtgggatagcaaatagcctagcaagactaaaaaatcgttttgagaataaccctatatcataaggacctctccttaatttatgttctccaagcactttcagtctctatcatcttattgagctatgaaatgtatagatgttcatttcgtatattgtctctcacttcacagaactagagagactaaactactaattttatatctttcttagtatatcatagaatgcacatttatggtaggctactaattgaccttgtatgtgatataaagaccaatacatttttagttatttttaattacaaagtctggtcaatattttcttcaagatcctctggcctggaagtgagtttctgttatgttcctattgagcaacaagaaatagtgacaaaggtgacaaatgcaacaaatgacaatgttcatgagagttttattaagtttattaacagagacatactgctttacttacctgaagatatcagaaaattacaatttgtttcatctttgttggtagctgcactagctgttccattacagaggaggagttgatttatgtgcagctgttgaaaacacaatgaaccagtcaccacaattttaacaagtgttaatgctggcatatccacttcagatagcatttataacactgtcatgaagaaagtttacagtatactacctaaagtaatgatgctagttccacatttgccaaatttggtgtcactactatagtactggattctactgggatgacaataaaaattcactctttcatggtcctttaaacaaggccaaagcatatgtccaagatcgatgtttttttattctccccaaagtaagctttataacacttggactgggaaaaaacaaagtttgttttattatccacaattaagtccctccttagatttgtctccctcttctcattctttatgtattaaaattgtgagtagaacaatttagtcatagttacaattaggaaaggggtacatttttactacaagttaaagttaagtcttcacccccaagaaagttacaaaatgtgtgtcgtgtgtgtgtgtgtgtatgtgtgcatgtgcgtgtgtgtatctgcagaaaagaggtagacaaggagcaataatacaatgtgatacatacttaaaaagcaccaaaaaatggagcgagatgattgaaagtggaaagacctgagctaaatggtggactagagcttcttgcactcctctccccacagaaacatcaatttgaacaactacctacacacaaaaatacctacccaagagtgaaggaaaccaggtgagagatgacagcactttggtggagctcagaaataagaaatgatacacggaagagtgtaagacagacagttttatactacccacgtcaatccctctcccaaccccatgcagcacagtatggaaagataccctctgcttggtagaagaggagggaagtgagcaccagacgttaccttggaccccaacaccaggctgcctcagtaaatcccactgctgggcaggctcccatggacccagactttaggctggtactcacagactgaacctctaagcccaccatggcatcaggatagctcccacagactcaatatccagccacgacatgtagactcagtctccaggtccaccgcagggctaggccagcctcagtagccccagacttcagactgcccccagcaccaggctggccatgatggccctaggcttcaggcccaccatagcaccaggtcagcccccacagtcctattcatcaggccaacactcctggatatagcctctaggactgcccagtgccaggccagctcctgaagcctcagactccaggcctattccaggcttcagactaacccacagctaagtaggcccatgtagtcttaggtttcatgcctgccccaatgtcaggtcagcaccctgacctcaggcactaggctagaccccatgaacataggtttcaggcctgcccagtgccaggccaagtccctgtgggcccaccatccaggcctgtccctgtggcccactgcttcttcagcaaacccatggtccaggcctgccccaacagacgaagggtccaggcctatcccagtagacccaagcactgggccagccctgacagacccaggcgtcaggccagccccacagtcccacgttgcaaaccatctccactagctccaggaaccaggctggcccctgcacacctaagctctatgactgccccagcatcagactagcctcaggttcaaggctagtctctgttacccaaggcttcagcggccttagggaccaggcctgcttcagaaaacccagggtactgcccaccccagtagaccctggttccaggacagcccccaatggaccaaggctctagaatcacccctgcagactcaggctctaggccagtccctgtgaattcaggctatctgcctacatgagtggtcgcaggtactaggctcaccacagtgccagaccagccctcaaggactcaggcttcaggctcatcccagtggacccagatgccaggcccatcccagcatctggctagcccctgcagactcaggtgcaaggcccagcccagcaccaagccagcccctgggactcaggctttaggccagcctccaaggatacagtttccagtcctaccctaatggacttaggctccaggtttattcaagtagactcaatcaacagatacgccacagtgaatccagactccaggctcaaccccaaccagccaggcactaggtccatccacctgctgacccaggcaccaggccagcctgctcaaagactccaagagcaagcctgcctgtggatcacaccaaatggtcttcccagaatctctaaatggactgactagtgaagggcttttggagacgaagccagtttacaaaactagaataagcccatacttttttaaatgtgcagataccaatccaaaaatatcaataatgatcaaggaaatacaatcccaccaaaagaacaaaataaagctccagtagccaactctaaagatataaagatttataatatgtctgacaaataagtcaaattgttttaagaaagcttagcaaacttacaaaacatacagagaaacaattcattgaaataaaaaaacaataaatgaccaaaatgagaaactaaaacatttaacagagattgaaattattaaacaaacaaacaaacaaacaaattctggagctgaaaaatacaatgaattaaatgaaaaatgcaatacagagagtcaacagcaggcttgatcaggcaggagaatgtgtgaacttgaaggcaggttatttgaaaatatacagtaagaggaaaaaaaagaatgaaaataaaggatgcgagctcacaggatttatggggtagcatcaatagagcaaacattagttatagaaattaaagtagaagagaaagatgacaaaggggtataaagcttattgcttaaataaaatagtagaaaactttccaaatctgggaaaagatataaataaccaggtaaaagaagatcaaaagtctcaaatcagattcaatccaaaaaagactatactcagacatataatcaaactgtcaaaaagccaagacaaacagggcatcctgaaagcaataagagaaaagaggcaaatcacatataagggaaattcagtaaggctagcagtggatttctcagcagaaacgttacaggccaggagagagcagcataatatatttaaagagttaaagaaaaaagaaacctagcaactaagaataaactttacacagcaaagctgtccttcaaaaatgagattcaaagcataccactaaaggaaatcacttcatcacaaaagaagatggcaagagaggaagaaaggaataacggatctgcaaaacaaccagaagacaatgaacaaaatggcagtagttaattcttacttatcaataattaccatgaatgtaaatgaaagaaatgaacaagaaacaaataaatggaaagatatcccatgtttgtggattaaaataattaacattcttaaaatgttcatattaccaaggcaatctacagagtaaatgcaatccctatcaaaatttcacagacattttttacaaaaatcgaaaaatcaatcctgaaatttgtgcggaaccacaaaagaccccaaataaagcatcctgagcaaaaagaacaaagttaggggcagcacactacctgacttcaaaatgtactacaaagctatagtaactaaaagagcataggttgagtatccctaatctgaaattctgaaatctaaaacactccaaaatccaaaattttttgagcagtgacatgacgctaaaagaaaatgctcattggagtatttcagatttcagatttttgaattacgaacgcttaaccagtaggtataatgcaaatattccaaaatctgaaaaatccccaaatctgaaacacttctggtcccaagcattttagataagggatactcaacctacactggcataacaacagatacatataccaatggaacaaaatagagagcttagaaataaatccattcctttaaagtcaattgattttcaacaaacgtgccaagaacacgcaaggagaaaggacagtctcttcaataaatggtgctgggaaaaccgtatatgcacattcagaagaatgacattaaaccttatcttacacatatacaaaaatcaatgcaatatggattagggacttgaatgtaagacctaaagctataacatcactataagaaaatgaagaaagggggtggctggaaagatggctgaataggaacagctctggtctgcagctcccagcaagatcaatgcagaaggtgggtgatttcttcatttccaactgaggtatctggctcatctcactgggactggttagacagtgggcacagcccaagaaaggtgggctgaagcagggtggggcatcacctcacgcgggaagctcaaggggtcagggaaccccctcccctagccaagggaagccatgagggactgtgccataaaacggtgaattccgacccagatactatgcttttcccacggtcttcacaacccgcagacaaaaagattccctcaggtgcctataccaccagggcccaggatttcaagcataaaagtgggcggccgtttgggcagacaccgaactagctgcagttttgttttcataccccagtggcgcctggaacgccagcaagacagaaccgtttgctcccctggaaaggaggttgaagctagggagccaagtggtctagctcagtggatcccacccccatggagccaagctaagatccactggcttgaaattctcgctgctagcacagcagtctgaagttgaccttggatgctcgagcttggtggggagagggacatctgcaattactgagacttgagtaggtggtttccccctcacactgtaaacaaagccaccaggaggttcgaagggggtggagcccatggcagctcagcaaagccactgtagccaggctgcctctctagcttcctcctctctgggaaaggcatctctgaaagaaaggcagcagccccagtcaggggattatagataaaactcccatctccccgggacagagcacctgcaggaaggggcagctatgggcgcagcttcagcagacttaaatgttcctgcctgctggctctgaagacagcagcagatctcccagcacagctctcgagctctgctaagagacagactgcctcctcaagtgggtccctgacctccttgcctcctgactgggagatacctcccagcagtggtcgacagacacttcatacaggagagctccggctggcatctggtgggtgaccctctggggtgaagcttcaaaaggaaaaaagaggcagcaatctttgctgttctgtagcctctgctggtgatactcaggcaaaaagggtctcgagtggacctccagcaaactccagcagacctgcagcagaggttcctgactgttagaaggaaaactaacaaacagaaaggaatagcatcaacatcaacaaaaaggacctccacacagaaaccccatctgatggtcaccaacatcaaagatcaaaggtagataaatccacgaagatgaggaaaaaccagtgcaaaaagtctgaaaattccaaaaaccagaacgcctcttttccttcaaaggatcacaactccttgccagcagagaacaaaactggacagggaatgagtttgatgaattgacagaagtaggcttcagaaggtgggtaataacaaactcctccgagctaaaggagcatgttctaacccaatgcaaggaagctaagaaccttgaaaaaaaggtttgaggaattgctaactagaataaccagtttagagaagaacataaatgacctgatggagctgaaaaacacagcacgagaacttcgtgaagcatacacaagtatcaatagccgagtcgatcaagaggaagaaaggacatcagagatcaaagatcaacttaatgaaataaagcatgaagacagattagagaaaaaagaatgaaaaggaatgaataaagcttccaagaaatatgggactatgtgaaaaagaccaaacctatgtttgattggtgtacctgaaagtgacaggaacaatggaaccaagttgcaaaacactcttcaggatattatccaggagaacttctccaacctagcaagacaggccaacacttaaattcaggaaatacagagaacaccacaaagatactcctcgagaagagcaaccctaagacatataatcatcagattcaccaaggctgaaatgaaggaaaaaatgttaagggtagccagagagaaacgtcaggttacccaaaaagggaagcccatcagactaacagcagatctctgcagaagctctataagccagaagagagtgaggggcaatattcaacatttttaaacaaaagaattttcatcccagaatttcatatccatcgaaactaagcttcataagtgaaggagaaataaaatcctttaaagacaagcaaatactgagaggtttggtcaccaccaggcctgccttacaagagctcctgaaggaagcactaaatatgcaaaggaaaaacaggtaccagccactgcaaaaacatacctaatcgtaaagaccatcaacactatgaagacactgcatcaactaatgggcaaaataaccagctagcatcatcatgacaggatcaaattcacacataacaatattaaccttaaatataaatgggctaaatgtcccaattagcaaattgggactggcaaattggatagagtcaagacccatcggtgtgctgtaatcaggagacccatctcatgtgcaaagacacacacaggctcaaaataaagggatggaggaatatttaccaagcaaatggaaagcaaaacaaaaacaaacaaacaaacaaaaaaagcaggggttgcaatcctattctctgataaaacagactttaaaccaacaaagaccaaaaaagacaacgaagagcattacagtatggtaaagggatcaatgcaacaagaagagctaactatcctaaatatatatgcacccaattcaggagcacccagattcataaagcaagttcttagatacctacaaagagacttagactcccacacaataatagtgggagattttaacaccccactgtcaatattagagagatcaatgagacagaaaattaataaggatatccaggacttgaactcagctctggaccaagcagccctattagacatctacagaactctccagcccaaatcaacagaatatacattcttctcagcaccacatcatacttattctaaaactgaccacataattggaagtaaaacactcctcagcaaatgcaaaagaacagaaatcataacagtctctcagacaacaatgcaatcaaattagaactcaggataaagaaactcacacaaaaccgcacatttacatggaaactgaacaacctgctcctgaaagactactgggtaaataacgaaattaaggcagaaataaatacgttctttgacaccagtgagaacaaagacacaatgtactagaatctctgggacacagctaaagcagtgtttagagagaaatttagacactaaatacccacaggagaaagtgggaaagatgtagaatcgaaaccctaacatcacaattaaaagaactaaagcagcaagagcaaacaaattcaaaagctagcagaagacaagaaataactaagatcagagcagaactgaaggagatagagacacaaaaaaacccttcaaaaagaaaatcaatgaatccaggagctgattttttgaaaagattaacaaaatagatagactactatccaggctaataaagaagaaaggagaaaagaatcaaacagacacaataaaactgataaagcggagatcaccactgatcccacagaaatacaaactaccatcagagaatagtataaacacctctacgtaaataaattggaaaatctggaacaaatggataaattgctgaacacataaactctcccaagactaaaccaggaagaagtcaaatccctgaatagaccaataacaagttctgaaattgaggcagtaattaatagcctaccaaccaaaaaaagcccagaaccagatggattcacagccaaattctaccaaaggtacaaagaggagctggtaccattccttctgtaactattccaaacaacagaaagaaagggactcctccctaactcattttatgaggccagtatcatcctgataccaaaacctggcagagacacaacaaaaaaagaaaatttcaggccaatatccctgatgaacattgatgcaaaaatcctcaataaaatactgaccaaccgaatccagcagcacatcaaaaagcttacctaccacgatcaagttggcttcatccttgggatgcaaggctgattcaatacacgcaaatcaataaatgtaatccatcacataaacggaaccaatgacaaaaaccacgattatctcaatagatgcagaaaaggtcttccatgaaattcaacaccacttcatgccaaaaattatcaataaactaggtattgatggaacatatttcaaaatagtaagagctatttatgacaaaaccacagccaatatcatactgaatgggcagaagctggaagcattccctttgaaaactggcacaagacaaggatgccctctctcaccacttctattcaacatagtattggaagttctggccagggcaatcaggcaagagaaagaaataaagggtattcaaataggaagacaggaagtcaaattgtctctgtttgcagatgacatgattgtatatttagaaaaccccatcgtctcagcccaaaatctccttaagctgataagcaacttccgcaaggtctcaggatacaaaattaatgtgcaaaaatcacaagcattcctatacaccaattatagacagccaaatcatgagtgaactcccattcacaattgctacaaagagaataaaatacctaggaatacaacttacaagggactcttcaaggagaactacaaaccactgctcaagcaaataagagaggacataaagaaatggaaaaacatcccgtgctcatggataggaggaatcaatatcatgaaaatggccacactgcccaaagtaatttacagatttaatattatccccatcaagctaccattgactttctgcatggaattagaaaaaactacttaaaatttcatatggaacaaaaaagagcccatatagccaagacaatcctaagcaaaaagaacaaagctggaggcatcacgctacctgacttcaaactatactacaaggctacggtaaccaaaacagcatggtactggtaccaaaacagatatacagaccaatggaacagaacagagacctcagaaataatgccacatatctacaaccatctgattgttgacaaacctgacaaaaacaagcaatggggaaaggattccctatttaataaatggtattggaaaaactggctagccatatgcagaaaaccgaaactggactccttccttacacctaatacaaaaattaactcaagatggattaaagacttaaacgtaagacctaaaaccataaaaaccctagaagaaaacctaggcaataccattcatgactaaaacactaaaaacaatggcaacaaaagccaaaattgacaaatgagatctgattaaactaaagagcttctgcatagcaaaagaaactaccatcagagtgaacaggcaacctacagaatgggagaaaaattttgcaatctatccatctgacaaagggctaatatccagaatctacaaggaacttaaacaaatttacaagaatgaaaacaaacaactccatcaaaaagtgggcaaaggatatgaacaggcacttctcaaaagaagacatttatgtggccaacaaacatatgaaaaaaagctcatcatcaccagtcattagagaaatgcaaatcaaaaccacaatgagataccatttcacaccagttagaatggcgatcattaaaaagtcaggaaacgaaagatgctggggaggatgtggagaaacaggaacgctttcacactgctggtgagtatgtaaattagttcacctattgtggaagacagtgtggcaattcctcgaggacccaggaccagaaataccatttgacccggcaatctcattactgggtatatacccaaaggattataaatcattctaatataaaacacacgcacacgtatgtttattgcagcactattgacaatagcaaagacttggaaccaatccaaatgcccatcaatgatagactggataaagaaaatgtggcaaataaatatcatggaatactatgcagccataaaaaaggatgagttcatgtcttttgcagggacatggatgaagctggaaagcatccttctccgcaaactaacacaggaacagaaaaccaaacactgcatgttctcactcataagtgggagttgaacaatgagaacacatggacacagggaggggaacatcacacactggggcctgtcagcgggtgggagggtagaggaggagaaatacctaatgcagatgacaggttgatgggtgcagcaaaccaccatggcacgtgtatacctatataacaaacctgcatgttctgcacatgtatcccagaacttaaagtataattaaaaaagaaaaacaaaacaaagaaaaaaggcaccatgacattggtctgggcaatgattttagggataggaccccaaaagcacacaacaaaaacaaaaatagacaaataggatacacatcaatctaaaaagcttctgcatagcaaaggaaacaatagactgaagggacaacctacagaatgggagaaaacattcgcaaaccatttatctgataaggaattactatccaaaatatgtaaggaattcaattcaatagcaggaaaataacccgattttaaaaatggacaaaggacctgaatagacatttctcaaaagaagacattctgatagccaacaggtatgtgaaaagatgctcaatgttactaattatcagggaaatgcagataaaaccacaatgagttatcaccccacacctgacagaatggctattatcaaaaagatgaaagataacatgtgttagtgagaatctggagaaaagggagtgcttgcacattgttggtggtaatataaattagtatagccattatggaaaagagtatggaggttcctcataaaattaaaaatagaactaccatatgacctagcaatcccacttttaggtgtccatccaaaggaaataaattcagtatgtccaaacaggtatctacacttccatgttcattgcagcactattcattatagccaagatgtggaatcaacctaagtttccatcaacagatgaataaagaaaataaggaaaatatatacaaaagaattctattcagcatttaaaaggaaagaaatcttgtcatttgccaacgacatggatgaaagtggagaacattacgttaagtgaaataagccaggcacagaaagacaaataccacatgatctcacttatatgtggaatctacaaaaattaaactcacagaagcagagtagaatggtggttaccaggaagtggttgggggatgaggagttgaggatattatggtcaaagggtgcaaaatttcagttagaaaggaggactaaattcaagagatctattgtaaaacatggtgactacagttaataataatgtattcttgaaaatcactaagagagtacattttaagtgttctcaccacaaaatatgttaagtatgtgatgtaacacatatgttaattagctcaatttagttattccacaatttatgcatatttcaaaacatcatgtcattaaatatatacaacttttatttgttaattaaaaataaaattttttttaaaaaagaaaagaaatgactaattctctggggaggggtgacctcttcagtaagttatgtttgagctcattcttaaagaataactgggtatatacccaaatgactataaatcatgctgctataaagacacatgcacacgtatgtttactgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacaaggacacaggaaggggaatatcacactctggggacggtggtggggtcgggggaggggggagggatagcagtgggagatatacctaatgctagatgacgagttagtgggtgcagcacaccagcatggcacatgtatacatatgtaactaacctgcacaatgtgcacatgtaccctaaaacttaaagtataataaaaaaaaaaattaaaaaaaaaataaataaataaaaataaataaataaattaaaaaaaaaaaaaaaaaaaaaaaaaaagaataagtagggcaggccaggcgcagtggctactgcaggtaatcccagcactttgggaggccgaggcaggtggatcacttaagtccaggggtttgaggccagcctgggcaaaatggcaaaaccccgtttctacaaaaaacaaaaaaaattagacaggcttagtggcaagcatctgtagtcccagctactcaggcagctgaggcaggaggaattgcttgagctcaggaggcagaggttgcagtgagccgagatcgcaccactgcactccagcctgggtgacagagtgagactccgtctcaaaaaaaaaaaaaaaaaaaaaaaagagagagaataagtagaacacagaggagaggaagtgaaacgagagcagagcatttcaggccagacggactgctggagcaaaggcacaaagtgcacagaatgcaaaagtaaattcaaggaaaagttaatgttcctgtaaggcttgaatgtacagatggtccttgacatatgatggtttgacttatgatttttcaacttcacaatagtgcgaaagcaacatcgttcaatagaaatactacttcaaattttgaattttgatattttccgaggctagcaatatgtggtacaatactttcttgacatgccaggcagcagcaaaaagccattctgtttttcactttcaatacagtgttcaataaattgcataagatattcaataatttgtagggacatggatgaagctggaaaccatcattctcagcaaactatcccaaggacaaaaaaccaaacaccgcatgttctcactcctaggtgggaactgaacaatgagaacacatggacacaggaaggggaacatcacacactggggactgttgtggggtagggggagggggaagggatagcattaggagatatacctaatgctaaatgatgagttaatgggtgcagcacaccaacatggcacatgtatacatatgtaacaaacctgcacgttgtgcacatgtaccctaaaacttaaagtataataataataaaaaaagaaaaaaaaagatattcaatactttattataaaatgggttttgtgttaggtgattttgcccaactgtaggctaatataagtgttctgagcacatttaaagtagtaggctagactaagctgtgatgtttgctagattaggtatattaaatgcatttttaacttacaatattttcaacttataatgtgtttattgggatgtaaccccattgtaagtcaaggagcatctgtaatgtaaaagggtgctgacgggtagagtgaccatgcctatccttttattttactatgagacttggatgctaactgtcttctttcatagtttaatcagcatcacctggaagtctaacagaagaacacccacactaaactcctctaacaaaaccaggctactggcagatatatagaggggcagaaaatctgcaaaataaaagataatcaggaaaaataaatgggacaatgaaaagtatagaaatgatttttaaaggatgctcacctcaaacacacctgagagagtgttggtgagtggcagcagaccttaggggataggatggctgtttctgataaggattcgagccgagaataccagaagcacagtcttatatgaaaaaaatctaaaaaaatcttctagtagtggctttcactgcaaaatcagagctttcacatggaggcagcatgcaaaagacagccatttgccaatagagatcaaaagtcatgatacagatcatctttaaatgcaaagggcaataatttataagtcagatgctgctgatgtatgcatttgaccaagagtcacatatttgccagcccacatccacatattagaccttctgttctttattaaaataatatatttttctgactttttggaacacaggtcaccaactttggtgttacagaatggtcttggagcttcctctccaaatatacttcactatcctcactccctcttccctctctgatcttttacaacttatctttcttcttcattattttttcttctcttagcttatgtcttccgagagcatctatgggaattatctggggcactaccaatgacactcaagggttgaaagagactacagatgtgtacgaaaagccctccaagagatattagtagaattccttaaaaaatctgcatgatctggaattggaaaaattcttaatgaacatttgaaatcattagaatacatttaactcattatttctcatgccataaaactattagagctggagtggccttagagactataaaacaatttcttcactttatatttgggaaaaatgagaagagaggtgaaattatttatccaaggcaaatagctgttgataaaggaactgacagatttcttaggaaatggcttttttccaggttgaaagaaatataccgaattatttacctagcttcctttttattgcagaaaaaaacacaaataacatgatatctaccctcttaacaaaattttaaatgtacaatagagtattgctaactacctgtacattgttgtacagcagatgtctagatctttttcatcttccataactttagttagttttcttcaagggtctactgaagttacatttttagtgatagcaactctcgtacatttgcaggtaacttccaaagcttattttatgtgaagtcatatcaatataatctggtgtcttacttcaagttgcttcattttaatttaatgagaagtattccaggttgtgtgagaatgatactctcttttacacagttttatatttaaagaataggaccttgatatattttattccagtaaaattaaaagggcttgttcagcaaaggcagtaagtaaagttaaaagacaagctgcaggctgggaaaggatatttacaaagcatgagggattagtatccttcaaatcaataacaaaaagactaacaaccaaatagaataacgagcaaatgatatgaataggcaattctcagaaaaggaaacccacatggccaataaacacatggaaagctaataaacctcactaataaatgggaaaatgcacattaaaacacagtgagacattatttcatacctatgaaattgatgaaatatttaagactgacaatactgagggctggagatgtggaacccccatgaactatctgtggaagtataaagtggtacaacaactttggagaacaatttggcaatatctagtaaagttgaagatgcataccttccgcaacccagcaacaccactttaaggtgaaaaatatctcacacacatgcacaaaatgacatgaaaaaatgatgtgtataggaatgcttttcgtaatagtaaaaaatgagaagcaatctgagacatccatcaacaaggaaattgacaaatacattaagaaatagtcattcataaaatgaaatattctacagctgttaaaatgaatggatatgtatagtaatatagataaatctcaaaaatatagagtgaaaaaagcaagttactttatgatacatacagtattatacaaattttacaaacatttaaactatgccaaatactgttcctaaattcatacatgtgtacaaacacatggctggtaaagggccacaccaacttcgggggggtacttcctctgggtatgaagggagggaaatttcattagggaagggcacaaagtaaacttcaactggtatatggtatatctgtattcttaagtggctggaaacaaatacagaaaatattaatgtttggtaaatctgtatggtgagtataactgtacggtagttctcccttaactgcagttttgctttccacagtttcagttatctgtggtcaagcacagtctggaaatattaaatggaaaattccagaaataaacaattcctaagttttaaattgtacaccattctgagtagcacaattgaatctcactcattctactccatttcatctgaggcatggatgatttacggcctcattcagagtagccatgctgtatacactacctacccattagtcacttagtagacctctcagttatcatgtcaatagattacaagaggaagaaggctgagtacaatgcataagatattatgagagagagaaaaagagagagagggaggaagaggaggaccatattaatataacttattacagtatattgttatagttgttctattttattattggttattgttgttaatctcttactgtacctaatttatatattaagctttatcataggtaggtataggaaaaaatatagcattatataaggttcagtaccatccatggttttaggtttccactgggaatctgggaacatattccctgcagaaaaaaaggactactgtataccatgttttctctatatttaaaatttttcataatacgatgttttatgaaagaatagagaagtgtgttttctttacaactatcaatagtcacattcaaaaactaaagttaaccatgtggtagacattatgtcaactctgaaccctgctttgtcagccatcaacttacacagtccaaacagacagagttgggctttggtgccctttttgtaaataaataaataaaagtcccacaaagagataagcatatgtaattacacattatagtcgttcaccatatgtattgtcaagtgcataccaggatcacatttaaaaccattcattttctgtgcctcagaagtgctagcatctgcagacattagatccatattcaagccagtgagatgagttaccatggccctctgttaattatacacaacattctctactttccttgtgaagagtgctgtgcttggcttgggtccagacatcaatttgtggggtaaagtgtttttaggtttaagaaaaaacaaggcagtggtttgttgctttgtaaatggtgtaggaaaatttttaaaagtgaacaagagataattcaaacatatacaactgaaagcttgttagtagctagagctcagtgaaggaagaaaatcctagaaagtctgggaaggaaatgacttcaactaattttagaaagtgatttatatggtcttaaaatggtttaaaaataaatggtcattattcaaatcacatagaccagtggtttctgagtctatgttaatatcaggaaattatactcacttattggggcttggatagataaaacagcctgtgtgttgatggacacaactctactaaatagagtaactaacccagccaaaatgcagaaacttgttaaaagcatctaaattcatggtcagtgcaaatacacaattatctgcagtcgggataaccaaaataaacaacactcagaaccataagaaggttctaaaaaacattcaagattgagaacttgacttttatgagttagaaaagtaatcaacgagcaaaagcagttcatgctaggccagggtttcatccattcagtgtattcagggacaaagccaacaattcacaaggtctgaaaagccatgcagtttctccaagtttaggcagaggcacagctacctgtaaatgggttgatatctaagtgtagatagatatacacaccaaattactgcacaactttgcagtgattctgccccctctgactggaatgctcttccccacttctctttgctaggttgcaattactcattctctaaaagcctcagcatgaacattacttctgtgggaagcatttctaccttttctaccctctacatctaaggttctgctaggtactctactatgctctgacaatcccccattacagtacttaaactttttaaagagtctgttgtcttccttatttggccataagctcatgagccaagagtcattcctgtcttgattattatatttttcccccagcatattacagtatctggcatatagtagaacttaataaatatctgttgactatattaatgaataaataaatagatacatagccagataaaagtatattaatgtccatccaattctacacagttcaaagtaaccattttttaaaagccaatgaggaaaaaaagtatgtttgaaaacatgaggatttatgtgtgcatgtctctttaagtttgatgatgatggtgaagtgtgcatgtgtttatgggtaagggaggggctttctaaatacacaaatactggtatacataaataattcctgaagagtcataattcctcggatttatgtatttatgctcaaactgtttccatccatgtttcatttattcttacaacctccaagcaaaagagataaggacagatattatcattgtcatttttccgaagaggaaatggattgagaagtgatgtgaacctgctcaactgcaaatggtatcccaatatccgagttgatgctccagccactagaacggtgtaacctggtaagatcacaattattaccacaatctttttagagcaagaaaaatagatatgagcaaatatctgaggcagaaagcaagcccataattcatactaactaatctgctttgtggtctctagtaaaggtaatttagcttctgggttcaaattacttaactagcacatacaaggggaaattaggggtacaatacaagtttactttccgttttcagttgataaaactttgcattaatattagtcagtcagcttaacagaagaaattaacaggctaataagatgaaatacatttaacaagaaagactaagattttagctaggataattaaatctaatatttttcttaaatgaaattgataggaaaacaaaaacttctggtctaatttatgtttgtaattaataccatacggaaagtaacattgggattaaaacatctatattcattgagctcttttttagccctatatgatccattttgattgttacacaaaatcatttaaatgaggggctctcccccatatttcctttctgtaaaataaaataataatcaatacaactcagtaggaagttttcaaatccaggaagcaaaataggtgctgctcccaaaggagttctgagggtcagttataaatgaaattatattacatttttcagcctcatatgatgccttttcatcaaggagctcaaagatttcccaggaatggccaacgtcctgggatcagtagaattaagccgtgaatggcgtctttgtctagaagtgaaaggcaatggtgaccttcctagactgagaactgagtagatcagccttatgattgtctctggttctattaacccactatcactggcatggcattcaactcaaaaggaagatttcactgttaaaagtaatctatgtgtttttagtgtttattgtaacatataacaaatgtgcacttctttatttagcccttctagcctcaccccatcttcaatgtactggctgatcctgctcctactttcagatctttctctctgatgggctacttgttgctcttcggtgctccatgagaataagaagcaataagaacaaaagtcacctattcctcaatagctggcataagaagtcatatattagggcaggatactataacagcaataactgctgttattaaatgcccattacatgccaagccctatatggtcaggtattttacatgcactatctcatttaattttatccacaaactatcagataaatattactgcttacttattttgtagaaggggaatttgaatatcaactggctaatttatttaccctaggtctcacagctaagtaaatggcagactcaggattcaaaccaaggttcgtctggttccaaaatacattttctatgccacactatcaccctgaagcaaaatgaggtgctctaaatagggtgttaggggtatgcatgcctgtaagcataaggaattccaaactttcagacattttctggcccaagaaatgatacagaactttgggtaacaataatggctaacattttttgagggtacagtacatgccagaaactgttctaggagctttacacacattgactcattcaatccttacaataaccctcttaaggtatatgctactatgacgcccatggcaatgatgaagcaactctggcattaaaaggtgaaatgacttactcaagattgcacagcttagaactggtggagctagaattcaaatttcagcagtctggcttcagagtctacatatttaacaaaaacattttattaatgagaaattggttgagatcaagaattgtcacaagaggaaaaagaaaataatcacagagttttagagttaagaagaaccttaaagattatttagtccaatcttcttatgttcctaatgagaaaagagaggcagagcaatattaagcaacttgcctaaggtcacatggcttgtaattagctgagcttgcatcacagcccaggccttctgacccctagtcatgtgctcattctattatatcatattatattctccctgatgcactcatgtaacaaaatgtgagttgaattcaattaaattgcctttctggacctgcacctgagctactaaacttgaatggggaaaaatgcacatagctgagcaaatgggcttcacgttcatttaaagcattcatgatcacaagcctcaactgagcactcatctctgctcaacaatgctacttctgtattaaacttgctttcccactctttaaagtgacaatatcttcattgttatcttcaatcctcctatattttcccccactccactccacttcctgccattaactaatgatatgcctcatacttcatggagaagaaaaaggtatcagaagaagtagctctttcatcttcctaccaccaaatctgcaaacctgtctatgtctctatctatattctgtgttgttaaaatggaacaagtgtcgctaaatcccatcctttcttgctgcttagactgcagatgttcctctttcttcttctgcatcatcatttctgtctttctactggaagttggccttggctcctactctttcaacattccatatattccaaccatcggttaaatcttatcttttgattataattctaaaatacatcttgaatctgtacatttttcatcaccattgctaacatcatccaagtcaccatgttctcttatctaggctcctgcagtaagtaaatagcctcctaactggctgtgtcatgcttccactcttgcccatctttaactcattctctgctgagcagctatctctagtacattttctgttgctataccagaataacacaaactgggtaatttataaagaaaagaagtttatttggcctatggttctgaaggctgggaagaccaatattaaggggctacatctggcaagggccttcatgctacatcataacacggctgaagggcagaagggcaagcaagcacacaaaacagagggaatgggggccaaacttctatctttttatcagaagtccactcctgcaataactaatccagtcctgtggcactaactcattcatgaggacagagccctcatgacctaatcatctcttacgggtaccatttcccaatactgttaacattggcaatgacctaatcatctcttacaggtcccatctcccaatactgttaacattggcaattaaattttaacatgagttttggaggagacattcaaaccacggttgcagtcaaagtagtcttttaaaaagtgtaaaacaattcattatcactcctgtgcttaaaatctttctatggattctcactgctcttagaataaaaatccaaacttgtttggacctataagcccagtatgatgtttacctctcccaacttcatctcatgctacattccctctcattcaactatactggccttccctgtgttcccgcaatacaaccactcatctcttgcctcagagacctgtgcttgctgttcctcaggctctttgcatgacaggtacttcctcaattatcaggtctcagcctaaaattcactttctcatagaaaccttttttccatgatatcaaagtaggtcctctcatatttttactcatccatagctatcttagcacttcctatagttgataagtattttatgcatatatttatgtatttccatgtttatttgtctgttgtaaagctcaatgagggcagcgacctttgtatatattttttcactgttgtttttacaatatctagcagagtatctagtaccaaaaaggtgctcaataaatttttgctgaactaaaaagttaattcctggattgctctgaataatatctgggacaatgctatttaataaggatactctaagtaggggaaaataattcttacttctttaggaaaagaatctggttgctttcatgatcccaaaccttttgccaacctttaatcagcaggttctaatctttttgtggtgatctctgtctgaattaaaaaaaaaaatctacaaaattaaaccagatgagggacaggaccctgaaggtgacagccgtttaatgctctctttgtcaaatatgctccgtctcactatacatgcttggacagaaagagagacacattttacttggttatttttttcctcaagccatttattcctctgctaagtagtttatcgattcttcaacatcaatttagagctggagcttacagcactcccatcagaaatcttacagtgctcaaaataaatgacttgcccaaagaataccatgtcagttgttaaagaagtaactctggaaacaaatacacctaaaggcagatactaaatatagatattcccttacacacacacacacacacacatacacacacacacacacacacacacacacaccccacttgggaactgacttttctaagaacaaaaagcaaaaataaaacagaaaaaaatctataacatatgaaaagttcagtagtatggcagtctaatacaaaaaatgttaaaattcactatagcctaccacctcccactgatgttccataatggttattttagacaggaagcacaaggttgccaaatgttcttgttctaaatttcctgtactagtttcacatcctacacatctagccctagtattaaaaatactgtccatgatattttacttcctggctttgagagcaggggtctcctaggcctgtctataaacctttagggactcaaattccaactttcatcctgtagaaagcatatctgccttcacacaccacccccttttagcaaaatgttggttatgctcaaatgctttgggattaggtgtgaggaaatcttgaattacatacctaaatataactccctaactggtgggccagataaacataagaaagacacatatgttttaataacgtcatctgaagtataagtattcatgtataatcacacacacacacacacacacacacacacacacacacacacacaaacagcactgaattttcttttcaccctagaatgaaagcaggtactaaactttcttgagtcttagcattgcacatttaaaataactgctttacatgttgatttggagttgcaactcatctgagatacggaggggattttccaaagtgcactggaatctgggcacacatgaaattgcaattactttccattccttttcttcaatttccccataattgctcttcctgatatatctctatcttctttgggggactatggaaaggggaccaacaaaacaggtagtctttcaaactgtgagaccagacagggtcgtttcattcaataaatatttattgagtacttgctaggtgccaggcactgttctaggagctggcatgacgagcccacacagaggttacacaggttcaaattagcttaagagagtaacaaggggggaagaatttctgatgtgtgaggctgtttttttgaatcaagcaatggaacagcaactgccataggctgtcagtagcaggtgaaatgtcaaatagggagtcttgtctttggggatgcctgactttagcttcccttctaatgccagcatagtacatctaaggattcagggaaaggatatccgaaaaatgaaggcgattttgctgccaactaagatgaatggaacactttctaaaggcagccctcaaaccattcttgccctgagccaggtttccactgttactttgatttacatcttgggtttaaggtccttctttaccttttactcctcatcactccaaagcagcaattagaggcagttcagggaaacaaattaactttattttataggaggaaacctcatagtaaacttctatcattcactaattcaacaaatgttcactgagcacctactatggccagaaattgctcttggtgctggagatatatatattagtatcagtaaacaaacagacaataagccctcatctcatggagcttacattttaaatgggggttgctaagttacaggcaattttgtaataaccacattacttagtactagtttaagtgataaaacaatcccttcttgttcctccattctctaacttccactatagagcccaacctttcagcccatgtcttcttgttgcttttgaagtttctatactactcctagacataacctttatattctctttcaactgactctgcctcctctcaggtactcaggcacatcccctttagttgggattagccctaatgaatggcactctccttacaatggaactccatctctttcagatcctgttgacagcaatttgactgaaatccccagggcactgggctccggtttctggtcttgggcatttacaaattcttgtttttcttaactgctctttaacctttacttcctgcttactttgttcctcttttttttcccctgataaacatttttcaaccatgttgagaaaggaggatagctgggaatataacaaagcaggatccaatttaaagaaatctatttgtcttttttttttttaatctcgattgtcaaagatgatttgaaaaagaaagcttctgggaccaggtaccgtgtcttcataaaactctgatctcatatatacattgttgcttcctgcagaatttctgcaagctgttctttaaaataattatgctgtgtgtttctgggttcttatgggattttaacattttgaaactgcaggggcaaacaggaaaatcttcaaatgtgattacttggtagtcaaataaaatgttataagaaatttctccatttttcacaccctccaatttttccaccccatctgaaatagaaaacaagttgaaaatacatcagtccaaagggtaattttatgaaaaagataagcacctaggaacagaggcttataatgaaagtgtctcctccaccatagagaaacactaatataattcaatatagtttataaaaccatccctgccaatcaaaatatagaaaagacaatttcctgtttgtggaaatagatgtgatactaaacagaaccaaatcaggctgcaattaacttagaaaaaaaacagatacactagactcagtctagctagaagaatgttgcattacaacacatttgcatgctagcttaataaaattaagatttccaagggaattctcatcctggggaggggaggcggtggggggtggaactgaatgagctatatagaaaaaagttaaatagtaaaaatagctatcattcacagagagtttactatgcacaaggcagtttacaaagtactttacatgcattttcttatttcattctcataattttaacaggtgagtgagtactcttattgtctcagttttacagatgaggcaactgaggctcagagattaagttagatgtatacattcacaccagtattaaggggtagaattcagatctatgtctgctcttaactgctaggttatgttgccaccaatagaatacataacatacatatctgtctatttaatatttatttacatgtaatatgtatgtatattatgataggtaaattctacacgaattagctaggcagaaagcagcataacatattagaaaaaaacacttgattaggagtcccgaggcctgggtttgtactctaggctctgacactaactagtttgtatggcttcaggtgagtaatttaacacctctgtgcctcagtttccccatctataaaacaagaatatcaagcagaagcttccataacatcccctttagctctaccattctattactctactgaaataagttatgtcacataaattaccatgaatgttttgcctttgcagataacttacaccgaaagcaactcaaggaataaattctgctaaaaagcacacccttgacacagcagatctgctagaaagagggagatgatttcaaaaggagaaacttcctgtgatagcaaatggagctgccagcgtagtctttgaactctccttcaccatcagccaacgaaagacttcagttattcttcactaaaaatgacagtctgcaagtattttggacctccaggtcgaggctaagttggcaagaactaaatggagagaaaaccattttacagggtcactgctaaatccagaatcacgggatttctgaagaaactgtatatgggtgactaaatcaaaggcttctgttaggtcaataaaaatgtttctaataataaaagtctcagactttgtttctgaaatatcactggtgctttaagttgaattgagagaaaggctagatatgaaacataactagaccactgttagagaattcccttctctagggactgagcatctgggaaaaatgtcacgtaaccttagcaagacacatggaatcacaatcaatgtaggcagactctgatttttgatcctttgtacaatgcacaataccaaattgatcagtgagtctccagaaaaaaaaaaatgagcacattcaaagactcgactggccttctacagggggttttcagcagtctgaggagcaactgattgaagagtcttaagcttttatgtttgtatttctccagagcagttcttggctagcttctctctgctctgctgccttcccaggtgactaacagctgttatctctgacccaggaagtagtgataagctacgttcctagctgcctttccaaagctctcaagagtgggtaaaagaggttactgatagtgtcttctcacttttactactgacagtgatggaattcctagagagctaatttttctcatgaaatattttattttataaaggtagccaaagaaaggcaaagaaaggctgggggagaggaagagagtaagctatttagctttatctgtgggttattttcctcatggcatagtactttgtgtttttaaattcaatgaaaccttttatcctctaggtgagcattttatatgaacccacagatggcttttttagttggccaatattagaaatacaaaggtgtctgaatgaatagataactgacattatcacagggttggaaagggaagaagcatatggcaggttgatactaggaattattaagataaaattgaaagtgttggaatttgaaagtgggtactaaattcatttggattacaaattattacaatgagaaaccagaaccttacagactaatcaattttcattaatggatttcttttgaccttgtccagtggtttctaaattggttcttgcaacagacccttggaatggcttctctccatttggtggcccagtgcattaacttatacttctcctgtgccaacagctcatctacagtaacagaagtgaagcctttctactatgagctctgagtacccaactaagtccacaaatggactagaaaggtcatagctgctcactaaccagtagacatgtcaaatcagatttgtataattttagagttgaaatggtcctttgaggttatcttacttttaaccttgatcccagtaaaagaatctcattcacagcatgcctaacagtggcatctagacatacttaaacatgttcaggactggaaaagtccttgcttcataagaacacccattccaccgccagacagtttgaatagaaaggttttcccctatatgctaggcgaaaatctgaattcctatggctacctgggttcatatccaggttccctcatttatatgatcttgggtagatcacttaatctctgtgtttcagtttctttatatgtaaaaatggagataacaatagtacctacctcataggattgcaattaaacaagttaacacaaatcaagtacttagcacagtccctggtacaaaataagtgctcagtaaatatcagctcttgatcttactgctaatattactgctacatttacaactgctactatcactactaaggataccctctggagtgacacatatcaatcttcaatcctcttgttcatatcagctcttcaaatatttgaagactcctatccaaagcatgagcttcaaaggtatgcatctctctgctttatattaactctgtattaggcaagttatctgataccttcaaatcagacactttgaaagcagataacacctactatcctggcatgatggctcatgcctgtaaccccagcactttgggaggctgaagtgggcggatcacttgaggtaaggagttatgagaccagcctggccaacatggtaaaaccccgtctctgctaaaaatacaaacattagccgggcatagtggtgcatgcctgtaatcccagctacttgggaggctgaggcaggagaatcgcttgatccaaggagacagaggttgcagtgagccgagatcgcgccactgcattccggcctgggggacaagagcgaaactctgtctcaaaaaacaaacaaaaaagaaaccaacaacaacaaaaaagaagataactcctactgtacagggtggctgtgagaataagaagagataatatacgcaaagtgcctggcacaaaagaggtacttaaaaatatgtcagttcccttccccttctccattcctaagttttttcttttctagacactaaaagcccaatatctaacctttctttacatggtagtgttttccagcccctggccatctttgtttcattctagtctgtcaagtatctttcttaagaagtagttcccagaatgatagaaagcatgattttaggtatggcccaagtatgccatgcagagtagactgttccttaatctcgagaagataaagctcaactcaaggcacatgtggtcaaggtaggggtcacatatagtctcttatcactatgatattttttgttcattgatttccttttttcctggcccataggctaatgagtgataaattccatcagaaattcaagttacttactgaatcagaggagttgcactggcctgctcctgtagctctttcctaggactctgctttcttagcagttgggatacatacacaatgcagtgaatctaattcctgccacacacactaaggggcattgccgccaaagtgtctcttgcaatccattttatgtggttgctttccaaggcaacttactgaattaaaaagataataaatttaatcttgttggttactactgattaagcatctcaagtcatgtaaagaggtagagttcatgctttggaagtgtaatattggagttcagttttcacctttctgattttctggaggcagtaaagaatactgagaagatcactaattgagtcaaggaacttgagatcaagccctatctatgccactaacctacctagtgtttgaacatggatcagtcatttaacctatttggatcacggtttcctcattcataaaatgagggtgttggactacttaagttttaatatctcttctgggtccaataatgtatagttctattctgtagccttatggttaaggtattatatcttcccacaccatacttaattgctttttaaatcaggttattgctgaggaatagcccgggaaaaatgggagttttaaacaacttttataattttaatagagaactgaaatagttgaatatttctcttcctaacctcttgcttaaataattttaaaacagttaattaaattatgctttacaaagattatcattatatatccaagctgaaggggaaagttcaacatttacaattgagttacaacagagggctgtattgagcaagaccatttataatgtattaactataagaaatggaacctgaactttagtagacaaccatactcctcacagctcaagacctagtaatatgttgtaaaaaagtctgagaactatattgcccatgactttggatcagcaatcatacaataaatatgtttaaaatttttgttattaatttaaatcttaatgtagtcatcaaaactactgtcaggtaatgcctttttgcctctagtgcatgtaaaactatcggtttatgagagaatttcaatgtatgggctgacatcttggataggctctactcttttttacaatcctctcagaaaacagtctatatttcatcctacctctgtctctccatttctataaaatggaggaatttttctctcaaaatcacagtaagcattaaataaggtgaaatgtattttaaatgccctataaattaaaaatatcctggtcatcttattatcttgtaactatttaacttatgttttaagtagcacagatttatagagagcatatcaccaatgaagtattactgtgcaagtgaattttagatgaagtacagatacattttttaagaaaaatatacagattatttacatttgagctataacaccattatgccttatgttcaaattattagaaaattataggccaaaaatactgttgaaattaaaatgcattctatatactctatggttaaacaactcacaaccaattaaatcaacgtgaagaaaccaataataattattaaaagctagagtaggagcaacaaaaagcaacaaccaactcaatgcacacttataatacaagattttctctcttttaaaaaataaataaataaataaataaataaataaataaataaataaaacagtctattaaaacccttggccgggcatggtggctcattcctgtaatcccagcactttgagagggcaaggcatgtggattccttgagtctaggggttcaagaccagcctgagcaatatggtgaaaacttgtctctaaaaaaaatacaaaaattagtcaggcttggcagtgcatgcctgtagtctcagctacttggaaagctgaggtagaaggattgcttgagcccaggaagttgaggctgtggtgagctgtaatcacaccactgcactctagcctgggtgacagtgcaagaccccatctcaaaaaacaaacaaacaacttcttactttgctcaatgagacctacagatacacagcccaactgaaatcttaagaatcaacactggttattcttattaataaaaactgttctataagacagtgatagaatctgtttcgttttggcttctaattggagaaacaccatactgagtcatgggccatgttctggattctgacagtggcatcactggattgttttagaggagaacacggtccttttcctctatgaatatgctcttgaatgttaagaatatttagtaaaacacacaaacacacacacacatttgcagggtgggagttactgtattattttgcagagtgtattgtatttgctatcatctacttctctaatggactaaaaaggtagcaaatatgaaaataagaaaaccacaaagaagccccatttttctacattctggcattcttcagttagattcagcagtggctaaaagataacacagtggaggagggggaaaccttggattaccacagcatcatttatactgatatttccaaaggtcataagaatttaggaccaggctcgcttcccacccttagttcactccaacatggccattgcttccatgatgacatgatttcccaataatcctttacagggctagagaggaataaacagcagaatttccaaaggcctatgttattactttgctttccccaggtgggatccttgttgctgtccctcaactgtgactgagagccactacacagcagatggttaagaaaagaggactaaagtttaaattaacaaccatcaccaaccaacattaagcctccctttgaaacaacaggaactgtgaaatctgagtctacatttctgttgaagggcaacaaagcagggccttctatgggagacagcatttactgtctttttaacataaatacatcaagctagaatacatcaagaagaagataatagtgcatcactaattcagtaattgtcacaggactctttccttctcctcaattaaacagttaacagggagctgggattcacacaaaaaaagaaattcgctcctcctcccctcttttccaatttgatttatgcatagcccctggagacacaaattaatgtcttcatagaccaaaagccccagctgttttgaaaaatctatgacaaagcttaactaaggttcacacatgcaaacataaagcccccataattactaagttgggtattacaaagctggctcctcaaccaagggtctaaagccagccgtaatgccgtgctcaccccagccaggctggccttaatacacctatagtgctaatttagtactgcctgaggcattgtggattctgggtagatagacactttaagcaaagctgaggaaaagatatagaactatagggacttaaaaccacaattcatcatttattaatatcagacagaagcactgaaaatatgcaagacttcatttcttatgtagctgattcctttggcttatttattctttttatgataagaaatcagaaaatgagatgattaattcaaagaaaataccaaaagaaactcttaatgccctatccatccttaaacgaaccaaaggcaccccactcagctactctacccccttggaagaatgtggcctgcatttgctcttccacttcctctcctctcatccactccttaatcaatgcattctgaattctgtccacagtattttacaacaaccctttcaaaggtcactgagactctttgttgctaaagccaatgatcacttttcagtccttatcttattcgttctctctgcagcactaaactctgctaattattcctactttcttgaaactctctcttcccttgccttctgtgataccccctaactcttgggtttatctttctcagttttttttcatgaacttctcctttacccatttcttaagtgccagtgttttctagcattccatctttatgcctcatttattctttctctaaaatcagggactcttaatctgtacatcatgagagttcatggatacacctcaagaggtctgtggaccttcctaaaattgtatgcagaatagcagaatagtgtacgtaaattttatgggggagagggtctatagttttcagatttctaaaggagttttaggcaaagtcaagtctaagggcaactaatcctcagattagctctaggtggccccgcaacttcaaatcatatcactatatatgctgataactttcaaatctatatttctaatccagatttttctcagtgtgggcatcccataaatacgtttactcaacaatcctgatcttcctctcgtgttctccaagtcagtaaatggctcacaccccacctagctgcccaagccagaaacctgggagttatccatattcttccctctctcccattctccatatccagtaaccgagccctacggactctacctcctatctcacatgtgaaccttctctcaataacaaacataataatctcagtccaggaagattattgcaataactgcctcacatgtcttcctgcctccaaccaactctctagttgcagacagagtaatccttccaaaagacaaatatgatcatgtcactcactgacctaaaaactttccggtgacttctttattgttcatagactgcagaacttcaaacttcctggcatggtaaataaggtcctttacgacttggttcctgcatatctctacagtctcgtccatactctattgctcaacaacccctttaacctcacccccaccctggcccaatccttgactactttataatctctagtcatacaaaactatttttcagttctagcctcagggatttcatacactttaacatcacatcagcctggaatacttgtaccaccttggcctgggcaacttctgccagaaagctatctctagccacctaaaagagagttagggggtacctcatatatgctccgatagcatcctacatgtgtaatcacatatccttctgtatgtgattctctatttctctgcttctctatttcccactagagtttgatgaataaactataagttccttgaggtcagggaccatttggtgtccgtggcacttagcacagtgtctggtacatcatagttggttaataaatatatgttgataaactgaatgaattaatgggaagaaaaaattttcagaattttgacccagtactgttaatccccacaatctttgccttcagcctggcataggaaacaaaacagtggactccagagaggtcagctgccttagacattaactctatgagcctcactttccacactgtacaactaagaaaaagttctgtataatctcttatggcttggcaattctgtaatttgctgcttccttaacatatctatttctcatctcccaaacctcacttagtccctccacccgcttccctactccccccttgcctgtcatccagatggcactgtgatgatctggttgaggcatttggagactggttgggtaaaggccactatattttgtgcatgtatcgtgttcatgagagagagaaagggaaagagaaagagaaggaggaagggagggaagaaagagagattgaggcaatcatctttcccttcccatttctatccttcgtaaagaatacagttggtcttagaggtccaatttcaaaatgttcatgatgttaaatcgttacacgataaaaaattcctaaaattgtttaagatcactcagaacagaaaaaaaagtaagataaaagttaaggataaccaagtagacacaaattatcttgaaaaagctgaatcgcagtaacttgacacagttttttggaataaggcttactaaacattgaaaaggaagggagatatgttatttgaaaggaaatacagcctgaacttccctggtcaagagaggtggaggaatcgtggctccagaagcatctgaagttactgcaaagctatggaaacatgtaacaataataaccagcactaagaatataataatgcaaggaccaattgtctgctggtccctgggggaggaaccagatggcataaaagaccaattctcatctcttaatttctttgattgataagaaggatacgcttccatttagttctcataaacagtgaccccttttctcctctgtggacaaagttgatgcactatcacttttgcttccagatattaaactcatatttaatgatatgtgtgcttggtaatgcatatgtccaaaaactttcactgacaaaaatggccctgcatgcatctatttgtctttcagttgctgcacacaaatgcagcagggaagtggggaatttaaatgcacagcaggcagccaatgtatttttccataaactagtctacatatcatggtaagagtagaagcaaagaaagcctcagatgcattctttcccataaagaggcaaatgaagccaaaggacagggtagtaagaaagaaaatcaaaggctaaaatgagattactagtacatacccttttaaaaacaaatcagaagaaccattatccttgccaacattgaagatgggttaagctctttcagtgcaaagaagagtgtattcttcctattgtaaacaaatccaatagttttgtttgtttgtttgttggtttgtttttcgagacagagtttcactcctgttgcccaggctggagtgcaatggcgtgatcttggctcaccgcaacctctgcctcctgggctcaagcaattctcctgcctcagcctcctgagtagctgggattacaggcatgtgccaccacacccggctaattttgtatttttagtagagacagggtttctccatgttggtcaggctggtctcgaactcccgaccttaggcaatctgcccaccttggcctcccaaagtgctgggattacaggcatgagccactgcacctggccaaccaatactatttttaacatggttagatagatgtcatttcacttcagaagtggttatgcttcggtaatggatagagttagtatatcatgtaaaaggttaagaagcaaaacaagaatatttaaaataagtagtaatgtacagaaaaaaagaaaactttcacaacgtgcattgtgcttgctggtcttgaatatcataaaactttgatagaaaaacacatatatttgtagggctcctatacaaattcctgctatatctcacttataaatacacaaatatatcattatattttcatatagtataacatatgatagccaggcagagatcaggggtcaggaaagctcacctgagtcactagactaatgaagtaggaagaaaccacaagagactacggaagatcaggttgagaaatcagggtctaacaaaggggtcagtctttgaaattaaaaactttatatgggaatacagactataggtgtgccctactttaagaaaatccactgtttccttatccaatccacaaaccagaaaagcaagagtgcttatgtgtattacagaagcactccatgtggcaatttttttttttttttttgagacgaagtttccttcttgttgcccaggctggagtgcaatggcatgatctcggctcaccgcaacctctgcctcccggattcaagcgattctcctgcctctgcctcctgagtagctgggattacaggcatgtgccaccacgcccgcctaattttgtatttttagtagagacggggtttttccatgttgatcaggctggtctcgaactcctgacctcaggtgatctgctcgcatcagcctcccaaagtgctgggattacaggcatgagccactgcgcccagccggcaatcttttacaatgctaagctaacattgtacatgcaagtaagatttgtttctacaaatatggaatttatatgttcagtttatcagaagcacattttcggtacaaagtgaggtatccatgtaccatcaaccttcatgtggacttgcttttgatttttcttttataaatctgaattttagcatactgtctccttaaaagttagaatgcctgtactgtgggaaataggcagagagaaaaaatccatacttcataagcagaaagctgaaactatgtccaaccagtccctattgaggaagtagagtttttcccacaaaagtgaatggggaaacattcttgaaacatcttaaagccctaaggccaaattcaggaggctgtaataaatgagaagtaggaagtccccagaaatctcctgaaaaggttgaattgtattatttatatttgtaacgaaatgtgttttcacgtttgtgttaaagatgaatctctggggtgagttcagcctgaggtaagcattgaggtctagtttaatggaggatgaagtgttttttttttttacactatatttaagcattggtcagatatacttaagacctatgaataaataaatataaataggattgctttaaggaactcctgagactgtctgtggttgtctattcatattaatatataagcataatttctagttgtgctactagtggcatccatctgtacattatatttctagaaaaatgttacaagtttgtaaaaatatattattctactgcatagagcacctagttattaatttcacttgtgattgatgttgccttgaatccaattataaaaaacaattaagctgctatattagcagagtggtatctattaggtgacctctaaggaaaaaaggccagatgacaaaggatccatagaaaaatcaggactaaaacctagacagttgtctattcttctgcctaacccagacacatatcataaagaagaatctatgtacatcaacagtataaaactttcactcagtaacagaacaaatttaaaccagctgttgtgaaactaatatctgcactcctacggtgaatgattaaagtcaataaatgtttgttgactgaccatgatacaaactattgttgtacattatataatgttcaatgattctattgtgttaaagataaaagtcactctaagtatgtaaatcctagttccagtattattctaggctaggagatcagctttcagtctaataacttcagacaagttttagttacagtctcatgaccacaaattatctaataaccccagtttcaaagctctctaaaaatagcctggtcatctactatctggaaaatgatgaaactggtcttggtttctccaaacctctagggtttttttgttgttgtttttgtttttgtttttgttttgagatggagtctcgctctgtcgcccaggctggagtgcagtggcgcgatctcggctcactgcacaaacccctaggttttaaaaataactgtacaataaatatgattacatatagttagaagatcttatgcatataaagagccatcgttcaatttatcaatgtcattaaataaagatgaacacctgaaaagattgaattacagattctcagtacataatgccaaaatctacaccacaataaatacactactcaagaaaaagtcatctatgagggaaaaaaaaagcagagagtaaaagaaaactgtgcaagtacccttaaatcaaatattgtaaatctagcatgaacttttaaaaagtggaggtcctatttttttaccaaatggagaatggatttctacctttgagttctaaactctctttgtaatacttttctctattaataaggtgctaataagacagaagtaaaatcaacccaaagcaaaaataaaccagaaaaacaaacaaaatctaattctatctggccacaaagccaattttctccctcccattgcactggcaacagcagtagcagcagtggctgatggcagcagacccttcctaaagcaatcttatatttgcaccagagagaacattctggccaaattggtcctagaagatgtgtctgcaagatgtaaaaaactgcaatcccagtgaaccaagattgtgccactgtactccagcctgggcgacagagtgagactgtcaaaaacaaaacaaagcaaaacaaaacaaacaaaaaaaaaccaaaaaaaaactgcaatcctaaatgatctctccttgaggaaagatgaaaatctttgtcagtaatattaggtaacctgggctggagaagatgtccaactgcaaaacagtgagtaggcaacaggtgaggaaaaggaaaaggaaaccaactaagcccaaagaaaccatagcaagaagctgaaagcactagttaaaatgaaactcgcatctgtagagaagcagtgagaaggataaatcaactaatggctcaattatacttttaaagccatcagtcaaacaaacaaaaaacccaactgaacttttaaaaccatttttagtacaacttatatttcacagttatttattttcttaatcttaacaataaacaactgttgttacataattaaagatacaaggtaaagggatttaagtggcagcttaagctagctagttaagttagttaagctgtaagttagaactacctatatatgttccagttttcacactcagtccatcccaaggactgtagtcagagactaaagacaagaaagatgtttgaagggatggtggggtggaggggagactatgagaatagaataaaaggattagagtgctttaatctggaaagataaacaatcaatcaagaataaccaccaccatacaaccatcaccattaagcacctactgtgtgacagtcactttgctaagtgccgagatattgaattatgtccaagaagagaagaagtgttgtcaaagtggattttaacattctttctttcagttatgctctctgtgtcaagcattgggctggtcatggaacagttgtgaagcaggaaacagcagaatgtcgtggaaagaaccccagattggaaattagaagatttaggttttagttctaagagcattattaactatatgtatgaccttgaacaaatcactcaacctttttaggcctatcttatgatagagatgttggacctgtcagcggattccaacttttttttagcagccaaccctttattcaaaagacaacttacaggaatatcctacacataaaagagctgaaagtagaaatcttatgcttgaagcacagggaaggtcataacaggctcataagccttctcctgggcctctccttctccctgaaccagtcttacatgcatctatacagatgccttcatggatcctgtgaacacagtttgaaaatctatgggctaaatcatctttaacaattccctctagatctaatatcctatgactgtgaaattttcctcacctacatcttcaatagcctttattcaattcagtccaacatgttgaatatctagaatcatagaaagcacatgacaggatttctaccatagaagagctcaccatctttttggggaaaacaaaataaataaaatgggaatgcacttgaggggaaggggggctttaagcagcaggacaccatcaagggcccattggaatagaaagtccacttctgtatcttttttatgagtgtatcatcagtgcctggggcaacagacattcaaataaacattgaataaataaataatgaatttatggatggatgggtgaagttattattaatcatgttcactgaaattcagcaaaaaggtataaagtactttccatattttatagaatttttttcttatatgtacagggttataagaaaagccatcaaatttctccattattcattctattatttactacccacaattacaaatggtgatattagaataaaaacaaagcaaaaaagtacacccattaagttagcatcctccttgaatcagcagaacaaataaaggcaaaattctactcaaccatatgaaataaaattttgtgggagcaaatcatcagactgaattttgctttgccaggaaatttttctttcaacgaacacgttttatatgtttacattcacatgctgcaagtaaggaagtctccaaagtaggtaaatcaagttaaaaacaaaggctattttctctgccccctattccactactagtgggaagagagcagggagatcaagaaggcagcagctgctttcctttttccccccaaacttaaattccatccaataagatatgttttgtctttttgcactcaaagtcagccagcaggcacttaagtgaaattaagaacaactgcaccaatggcagataatttgatggagagcttattggagacagctcatttgagtaaaagctttgcctgttcaagaaacaatataatttctgaaggaaatctttctggaaagggccaggtggctctgtaattttatggctcaggtgatatcagttatccaggacaagtgttgtacatgactaatattctcaaaccagaattgtatttccccagaaagctattacatttaaaaagacattaaggtgaacttaaattccatttttgttttagcctagccctaatttttattatgatatactatatactattccttttttgaatatgccttataaatggatatatattttttgggttcaagtgattctcctgcctcagcctcccaagtagctgggactacaggcagatgtcaccatgcctggctaatttttgtattttttgtagagatgaggtttcaccacgttgcccaggctgggataaatggatgtattttttttttcttttttttccttttttttttattatactttaagtaaatggatgtatttttataaaacagctttcttttttcaatctatggtgcctgatacctgagttgcttagagagatatcgaactaatagatgaaatgagaaacatcttatccctttctagtcttcctccaagatacaatgacatcttagggaaaaggtagcatccttttctctgttctaacaaatgtagacagcccagtcaatgtgtggctccacagatagctacaacaaaagtcatactgaggaggataatacggcagggttctgaccacacagtatgacatcactgctttcttctattcattttagctattcccctgtaaaatctggattcaattcaatgtcttcagtttcatttggaagatctacatttggaatcgatccagttagtccaggggccacatgaattttaatgcacctggggcagctggccaaactgtcatttgcttctatcatctaagcaaaatgtggaaatttctagtcaagacttttccaattttcaatttaccaccttctcatcagagggctacaactgctgttttcagaaagaccttgcccctatcctaggacaagaaatatgacttagatgagaaaaaaaagaagaagcaaagaaagaaaacagaagttattttcttcctttcacacattttggcctaagtttggtgtatatatctaatctaatgttattgtctagtagcatatgagttggttaaaattctttacactaagtacccagaattttctattctttcttctctcttccacccaaatctcttgtgacgtatttattcattcaattggccaaaatatttatttagagcctactatatgccaatgacttttctaggcaatgggaatacaaaagtgaacaaaacacagcccatgcacttatagagctctgacactttccaaggagagagacagtgaacaaatccatagatacaaaatagagaatcattagtcatatgaaaaataaaatatcacatagtgataagtgatataaagaaaataaagcagggcaaacatatccagaatggtcataaaggccattctgaagaggtgaaatttgagcatggctttaaatgaaatgaagacttgtcttgatttttctttgtattcaaaggaaacccaggaagaggtcactaaaattactgtgtcctgagttggaagtaaaaacagtcatggagttgagacatttgaaaaataccatcaagatattcaaggatgtcataatcaagctgaagatcatctactaacgtcaactaaatgattgaagggatgaaaaatggctgagaagggacataattgaaatataccatttcaatgaccattatgaacattatgtacgggagatcataataggacaactccctatttaaagtggtgaattacaacaaaaaaaatatatctgagtctctagtttcaagacaagacagcatagttgcacatctctctatttctcccattaagtacagctaaaaacttggacattatatataagacaaacataagaacattttcaaaggtggagaaaaaaagtagacttactagggactttgagacccagggaatgacaaagtggtgaattccctgggtattttttttttactatatatatcccagaccaggtattggtaaaaccagcaacctagaaatgccaatgggcagagggaaaaaaaaagcctcaagaaagccagcttttggccgggcgcggtggctcacgcctgtaatcccagcactttgggaggccgaggcgggcggatcacgaggtcaggagatgagaccaaggtgaaaccccgtctctactaaaaatacaaaaagttagccgggcgtagtggcgggcgcctgtagtcccagctactcgggaggctgaggcaggagaatggcgtgaacccgggaggcagaggttgcagtgagccgagatcgcgccactgcactccagcctgggtgacagagcgagactccgtctcaaaaaaaaaaaaaaaaaaaaaaagaaagaaagccagctttctctagtcaaaggaccaagaagggggagtacagcaagacagaaaacttaaacaatagccaaacaacacaagaaactgcacccctaacctcatccctatgagcaagcactgagtgaggaaaccggacttccaccttctccaggatctaatgaggtgtcccaaccaacctacgggggtggtgtatcaaagaaggccaagtagagagctgggtttttttaaatccccaatcagcaatgtcataggaatcaagtgctcctctctatcaaccagggtgatgtcagcaaaggcctaaaggggagcttcaacttccacttccaacaagcagtaatgaagttcccccacccccatttcctagagtttcaatggaggctgagtggagagtctgtatttctacttccacatggcagtaataaggtaatgaccacttcccctgccagcatgatgtcagaagaaaccaagtaaaacagaagatttaaataagatccagagtcttataatacccaaaatgtcaagaattaaataaaaatcacttatatcaaaaaccagggaaatatcaatttaacagaggacacaaacaccaagatgacacagacgttgaaattatctgacaagtattttaggccagctgttacaaaaatgctttaatgagcaactatgaacatacttaaatttaaaaatagaaagtttcagtaaaaataaaagatgtaaagaaaaaccaaatgaaaaaattaacactaaaaatacaataaacaaaaatttaaaaatcctggatggactcaatagtagaatacagacagatgacagaggaaagaatcagtggacttgaagatagaacaatagaaattacctaatatgaacaataaagagaaaatagagtgaaaaatagtaaacagagcctcaaggacgtgtagcacaataacaacagatctaacgtttgtatgactgaattctcagaacaagaggagaagaatgggtattcaaagaaataatgggtaaaaagttcagaaattttaccaaagacataaacctacagaatccaaaagctgaactaaccccaaataggacacacacacacaaatctgcaccaatgcaaataattaaactactgaaaactaaagacagtgaaaaaatattgagagcagcaagagagaaacaacacatttacctataagaaaaaaaaaattagaatgatagcagatatataagaataatcatacatcatgtccaattgaggcttattacagggatgcaaggctggatcaatattcaaaaaatcaatcaatggaattcaccacattagcagaataaagaaaaattgcattatattaattgatacagaaaggcatttaaaaattcagcagtgattcacaataaaatgtctcggaaaacttatgaatagagggggaacttcctcaacttggttaaaagcatctacaaaaaaaatctatagctaacatcttggtgaaagactgaatactctttcctattattggtaataaggcaaagacatatcctgtcaccattcttattcaatacagtactgggagttctagccagtgcactaagacaagaaaaggaaacaaaaggcatacaaattggaaaggaagaaataaagttcactctatttgcaggtgacatgagggtctatgtaaaaaatctcctagaactaatttggaattcagcaaggtgagaggctataattaataccaactacaaaaatcaattatatttctatatattagcaatgaatatgtggacaccgaaattaaaaataacataccatttacaattgttcaaaaaagagaaatatgtaggtataaatcttaggtacttaagtataaatcttcggtataaatacttaggtataaatctaacgaaatgtgtacataatttatatgttgaaaactacaataacgatgaaaaataaaagaagacatcaataaacggagacacatactgcactcaaggattggaagacagaacataggaaagatggcagttctccctcaaaatgacgtattggttaaatgcaatatccatcaaaatcccagcaagattttttttcagatagagacaagcttattctaaaatgtatatgctagacaagcttattctgaaatgtatgtgcctaatcaaagaaagaaaaatctttgggatctagggcttgctctagacatgacaccaaagtacaatccataaaagaaaaaaaacaatacattattattcatcaaagttttaaacttttgctctgtcagagactattaagtagatgaaaagacaagccacagattggcaaaaatatatttgtaaagcacatatctgaccaaaaaactcatatacctagattatataaaaagctctcagaactgaacagtaaaaatataaccaattagaaagaaaggtcaaaggacataaagagatatttcataaggatgatatacagatggcacataaacagatgaaaagatactcaacatcactagccctcagggaaatgcaaattaagatcacaatgagatatcacgctcacctatcacagtactaaagtaaaaacagtgacaccaccatatcctgccaagaatgctgagaaactatcatttatattactggtgggaatgtaaaatgtctcagctactctagaagtagtttgtcagtatcatttaaaaaagtacagaatgccttatccaccatgatggtattacacgtagcaccatttttgatcaagaaagtcatttcacagcaaatgaagaatggtaatgagcctttgctcgtggaattcactagtcttgccatgtttcccatcatgctgaagaagcgggtttactacaatggtggaatggctttttgaagattgagctacagtaccaggtaggtgacaatgtcttccagaggtaatgtctttcaggatgctctaaaataatgtccaacatatggtgttatttctccaacagccaggattcatggattctgtaataagtattagaggtaaaaatgggagtggcttgattcactattactcctagtgattcacaagcaaattttgtgctttctgtcactatgaccttaggctctactggtccaaaaggaactaagttcttttggaacttagtggttccaacgttgaatatataatttcaacgtctatatatattcttatatatcttttggaacaaactaaggaactcttatttccaaaaggaactaaggttacagtccctggaacattcttcatgatagactctattcaagtccataaaacaagtcacagtaaatttgaaactatttaaatcatatagaacatcttctttggcacaatggaattaaataataagtcaataacaaagaagtatctaaaaaatataaataatatttgggtcaaagaagaaaccccacaggatatgtaaaagtactcagctgaattaacatgacaacaggctatatctaaatttgtgagatggggcaaagcagtgcgtagagtggaatatatagcaataagggcttatatgttcatagcagacttattcataatacagagaaaaattggaaaaagcacaaatgtgtattaactggtaaatggataagccaactgtagttaattcatataatggcacattactcaaaaataaaaatgaacatactactgataacgctcaacaacatgggttaatctaaaaaataaaaatgctaagggaaaaaagtcagagaccagaaagcatagagtgtatgatcccatgtatttgaaacttagtaacagacaactaatttatagtgatagaagtcaaaagagtggttgcctatgcagactggagattgactggaaacagtcatatagagaaactttctggtgagatgaaaatagtttatgttttcattatggtgttaactacaaaggtgtatgcatttgtttaaagtcatctctaaagtagtcaaactcacagaagcagaggatggaatgccaagggttctaagggctgtgaggaaagtgaaacggagaagtattagtcaaagggtataaagtttcatttatacaagtcctagagatctactgtacaacatagcacctacagttaacaatactcattgtatgctttaaatattcctaagagggtagatcttatgttaagctcttatccccacatacacacaaataataaataagagaacaggaggaaattttggaggtaatggacagacttatgacatagatagaggatggtttcatggtgcatataattatctccaaactcatcaagttatatatattaattatgtatagttttatgtatgtcaaaaatattaagtaaaaaagaatgctgaattcaataaaagtattcctttaaacagcaaaatgtaattagaaaactcttttgtctcaaatatagaatttttttaattacaaatgaacaaatttaaaaatatgttagataaaatcactgacaatagatccatagggactactgaaagaaattagaatgtttttcctcccagaaatactactacgcatttgaggttggtattagtgggacatatgatgatttcctaataaagtcttctcagaaacagaatgctggattggctagatgacaggtatacctaatcatgggctttttcctttttttttttttttttttagacggagtcttgctctgtcgcccaggctggagtgcaatggcgcaatttcggctcactgcaacctctgcctccccgggttcaagcgattctcctgcctcagcctcccaagtagctgagattacagatgcatgccagcacacctggctaatttttgtattttctgtagagatggggattcgccatgctttggccaggctggttttgaactcctgacctcaggtgatccgcccgcctccgcctcccaaagtgctgagattacagatgtgagccacagcgcccggccaatcatgggcatttttacatttctacctatgaaataaagcacaccgggaaaaaaagtcaagctttattcttttagattatgataaatgtgcattaaatacctttttaaaggtccaggatgacactatcttctttctccccaaagatacaagcaaacatgagtcttcccataagaacttattttacatggtattggtatcctagagaggtaaatgcagtaacctaacaaattcaacttgtgagtattggctgtattacagtaactcagatgtatattgattacactgagagatacaatatttgagtgctatcaaacccacaccatattgttattctgcatgcttctcctgcatctgagatgcaaatcagttattctgtcccataactagttatattagaattttaaattgaagaattggaaacaattcaaagttgtagagaaaaatttataaccctctaaactgaaactgacatacccagagcaaggagaaaaagtgacccctcatttattcattcattcattcattaaacacttatttactgcctactatgtgtcagaccctatgttaggtgccaaacatttaaagatgggcaagatacgatcactgtcctttaagaaataacagcctggctgggcacggtggctcacgcctgtaatcccagcacgttgggaggccaaggtggatcatgaggtcagcagtttgagaccagcctgaccaacatggtgaaacccagttctctactaaaaatacaaaaattagccaggtatggtggtgtgcacctgtaatccaagctactcaggaggctgacacaggagaattgcttgaattgcttgaacccgggaggcggaggttgcagcaagctgagatcgtgccattgcactccagcctgggtgatagagcaagactctgtctcaaaaacaaaaacaaaacaaaacaaaacaaaaaaacaaaaaaaatcctaaatgggataaacagataaacataaaatgatttttaaaaatgtttaaggcaaaaataaaaatatgcataaggcaaactgaagtccagaggaaaaatcaaggaagacttcctgaatgagatagtacctgaattgagtcttgcagagtaagtaggagttcacctggtgatgagaaatgtagagggtatacttcaggcacaatggactacacaagcaaaggcaaagccatggaagacaaaagcagcagagtgtgtataaactataaatagattaagtgttttgagcaagggagtgacagaatccaacttgtgtttgaaacataaatgtctgacagggtgggggatgcattagaggaaataagggaggcaagaagacaattaagacaccattgcagtttagacaagtaatgatgtggtgcttaactagggataaggcaatggcaatagagaggacagaagagactgtggtcagtggtcaatttacttaattttaagataccacattcttttgattttcctcctactcctgctcactggccattctttctcagttttctttgccggttccttgtcttctccgaaactattttttttttttttgatggagtctcgctctgtcacccaggctggagtgcagtggcacgatctcggctcactgcaacctctgcctcctgggatcaagcgattctgttgtgtcagcctcctgagtagctgggattacaggggcaagccaccacacctggcctaatttttgtatttttagtagagactgggtttcgccatgttggccaggctgctctcgaactcctgacctcaggtgatccacccgccttggcctcccaaaatgctgagattacaggcatgagccactgtgcccagcttctctccaactttttaacattggattaatccagggctcagttcttagatctcttctctgtcttcactcccacggatttctttggatttaaaatactatgtatgtgctgaacactcctaaatgcatagctctagttcagacctgtcctctgtgctccaggtttgttttctcacctaactgcttgacatttccacttcgatgtctagtaagcatctcaaaccatcaagtctaaaactgaactcttacatgccaagcttactctacctacagtccttcccatctcagtaaatgtaacctccttcctcagaaggaaaaaacttgggttcatccttgacttccccctttcacacaccatatccaatctattagcatatcctgtttgttgtaccctcataatgtatctgaatctaaccactcctttccattgaacagtttccaccctgcttccatctaccaccatctcttgcttagattactgaagcaacttcctatctggtctccctgcttccaccttgctcatacacctgtaatctctttttaagatagccacagcttctgcacagagaaggaaacaaaatgaaaaggcaacctacagaatggaagaaaatatttacaagccatctatttgataaaaggttattatcacaaataaataaggaactcctacaatgcaatagcaaaaaataataataataagtgagcaaagtacctaaacagacatctataaaaatgaccaggaggtatgtgaaaaggtacccaacatcactcatcatcagagaaatgcaaatcaaaaccacaatgaggtatcacctcacacctgcttgggtgaccatttatcaaaacaacaacaataaaaacaaaagataaatgtaggcaaggatgtggaaaaaatgcaactcttgtacactgttagtgaaaatgtatattgaaacacaatacggaggtttcttaaaaaattaaaaatataactaccatatgatccagcaatctcacttctgggtataaatccaaaggatctgaaatcattatcttgaagagatatctacactcccatgttcactgcagcataattcttaatagccaagcaatctaaatgtccatttatagatgaatgggtaaagaaaaggtggtgtacatacacacacacacacaaccaaccacaccctagaacaattatctagtcttaaaaagaagggaatcccggcatttgcagcaacatggatgaacctggagaatgtcaagctaagtgacataatgaaataagccagacacagaaggaaaaatactacatgatagcactatatgatgaatataaagtagtcaaactcatagaagcagaaagtagaataccagggtttccagggcctgggaggagagtgaaatgggaaggtattagtcaaagggtacaaagttttggtcgcaccagatgagtaaggcctacatctattgtacagcatagtgcctataagttaacaatactgtatggtgtattttaaaaattgctaagggggtagatcttatgttaagtgttcttgtcatatacacaaataataataaataagagggtgggaggacagttttggaggtgattgataggttaatgacatagattaaggtgatggttttgtggtgtatacttatctccaaacttatcaagttgtacacatgaaatacatatagcttttttatgtcaatcatataccagtaaagtggtttataccaataaagtggtttaaacaacaaaaaagacagtagccagcataatccttttaaaaaccacattatatcactcttctgctcaaaaccctccaaggactcctcattttactcaaagtaaagccaaggtatttacaaggtaaattacaatggcaattacaaggtatttacttaggagcctacaagatctgctccctccctctgttatactcttgtgaattaatctcctagtactccccttgttcattcactctgctctagtcacactagctccttaaaccctagttccttgaacaatccagacactctctcgtctgaaggtctttgtgctggttctttttctctgcttgaatgctcttcccccagatagccgctttcctccaaattcctccaaataattgcttaaatgtcccttctcaatgaggttacactgagcatcccatttaaaattgcaaccttttttcccaccaatgctttcaattctcctaaacctgccctatttcttccatatcactaattgcctatatatgtatacatacatacatacataatcacttatcaccttccagctatataaaatcacttaagactctgagtatgtgtgtgagaggggtgggtgtatgtgggtgggtgtgtaacatttgcctatctcccccttttagaacctaagcaataggaaagggatgttttttgttctcagatgtatttctagcacctaaaacttacttagcacatagtaggcactcaataagtatttgataaataaatgaatgagtatgaaacagaatctgtggtggatgagaaaatagggagcagccaccttagtttaaccttaagaagaataagagaatttgagaacaaaagcctatttgaaaggaataactgaggggcacagggaaggctaatcacagcttccttcttactctgaccaattcctgagctacagagaatacaaaagtggtttatgtctgtaaagcaattatctacatttcctggtaggacacaaaagactgaataaggtatacctcctattgcaaggtacacagcactaccctctcccattacctctaagccaagataccatgaaaactcacccacaccacaaacacaaacacatttggtttgcctcttataaagcttaggctaaaatgaagtttagggatgatctacaggttttaattatgcatgttttctcattctccttaacaaaaataagatttatacctccaatgtctaatctaaacatggactcagaatgttaaagctaggtgggacctcagacataagctaatccaaactcttcctttttcacttattagtttcctttttgagcacacagatgtctgtctttccaaatgagaaatgactatttcagaagtgtatcccttttgaaatgtacatacacacataaactccttctaaatattatacatatcttctccttcctcagtttcaaataggcatcttgtgttgttatgatgaataaaacacttttctctcttgccttaatcctttcttactctctgtagacaagacagggttatatcttttattttgagtaaatgagatatggtttatgaatctaaatgaatacctataatttttggatttagatagaacaacctagacctcatgaaattaatttagttaaaaattgaatttaaagatctgctgcaagacagcattgttccccttcctactaaattaccattctacaaaaatgcggattcttataatttcagttactaaactaaaatgtaatagaagtaaaggtaagaggaaatatgaactatgaggtaatctataatacctgtttttaaaattcaatttcttaccagtttagtctacttttttctatttctgtcttcaaatatgcactaaaacccatatataggggctacatttaactgtagttagtatcttatttcacattaacttacataaattgaataaaagtattgaaatttaagtggagttgttaatgtcaaacattttcttctgtctttctgggtgggtttgtagttgtaagagtcacttgaagattaattatctcttcatgtaaacctctttttctcatttggcttttcggtttcttctcagactgtgttttagtaaatatgtgtctttaaaaatcatataggtgtgagtgtatatatatttatatataattataatcataaatgtgattacatatatgtagtttaatatatatgggatatcatttttgagattagattataaaatgactctggcttctgtcttgggcagtctttcctgaatcaccctctctggggtagccactgacatttcatgggttagccctatggagaagcccgtgtggcaagggtctgaggtctgccaagaaccacccgagcttgaaagtggatcctctccccagttcagtcaagccttcggattcaaccacaggctcagttgcagcttaactgcaagctcacgagagaccttaaggcagaggaattcagctaaaccatttccagattcctgacacacaaaaactgtaagataatgcttgctgctttaatgtgctaagtttgagggtaatttgttacagggcagttgataactaatacaaagtccaagctcaaaacatagtcattgctatgtaagtagtttatgagggaatccatactgtttcctccagtaaaatcacctattttcctcttgtatccattatggctactcatgccaaaactgaaataaacaaatctactttaacaactaaattggacataatcttttggctgggcatggtagctcacacttgtaatcccagcactttgggaggccaaggtgggtggatcacttgaggccaggagtttgagaccagcctggccaacatgtgaaaccccatttctactaaaatacaaaagaaatccaggcatggtggtgtgtgcctataatcccagctacttgggagactgaggcacgagaattgcttgaacacgggaggcagaggttgcaatgagccgagatcatgccactgcactccagcctgggtgacaaagcaagactctgccttgaaaaacaacaacaaaaattggacacagatttttttttttttttttttgaaattaacgaatacactggtcttctgaaaaaacttgcaactaaaatttatgagccaataccaaaataagtttaaacaaaaatcagatttcttaatgactgtgattataactatttaaattctaaagtagttattcattttgaggccaatactgtttgcaccatacatccgcagcaaaagaatatatccgattcagatgaagagcacaaactaaagactagaaggtaaggctaccagcagggtcttggtctgtagaattatgcaaacagacatatcatctgcctccctctggctgcctcatatgtgaatcagcaaggctaaacgatctacctccatcttcactgtgcatttcaacaacactgtgctggcttccaataatactgcctgataagcaaatagagagaatcaatatgtttacagaggtttgtatctgaagatgttgctcattagttatttttcttcaatatgcttatatttaaaagttttgcacaaaactttcagcatcactagctaattatactcatttattgattcactaccatgtgccaagtacaattctacacacttaggaaacatcattgagtaaaatatacagagatcatttaagagagctttcacagagcttacgttatacattaaatcttctattctctgtggaatttgacatggctgatttatatcttcttcttgaaactatgtcttccattggcttctgcaatctgataggattctgttctaatagtctccaattgttttttcagccttcttcaggggctcctcctatcatatcctaatagccgtagatcctaagatttggctcctgggctcctgctttatataattcatttcctcaaaaaactcattcatttcctgaaatccaatgatcacctttctatatgtggcctctcgattttatatttctcattcaaacccctatatagtgattccctatgcatacatatttctattatgcaatctcacactttcaacaaacaagttaataacctagtcatcatcaactacttaaaatgggtttccctgttctttcattttctaacaatggcatcaccattctctcagtcatctagtctcaatatcaatcctcttttcctaatcaatcaagtcctattcattataccattaaaatatctctcatatccattacttgcattccattccagcaactagttcctcaccacttcatatacagataacattgtcctgattgatttctagtctttctatttccaacctctcattcacactacttctaggttaatttccatcactttcatcatgtcatcatcctgaatcaggaacatttaatagtttcccattgccaataaaatctaaatccctaatcttgacttttaaagctctccataatctggctttaatttatttatccagctaatctcttgctattcaccagtgcaaactatttactccagctgggatgatttccttactgtttctaaagcacatgatgcttatgttggccactagaactctgctcatgctggtcatcatgcttggaaagcttggcaagcatcctgttcacttttttgttctacaaaatcctatgtatgctcaagtctctcgttccgacaaatcccttacaacttttgtccacattctatgtttttagaaacttggttatcatctactgtctatgtcactcaatttggatcttagtcatatttttccatattttgctttttcattgtctcagctttcttatatttaatagaattctaggctacttaacagtaagacaagtttcttcacttgttaaccccattttttttttagtagtctaccacagcagttctgaaactctttgctttggaacccctttataattttgaaaaatatggaggaccccaaagagcctttggtttttgtaggttatatttattaatatttactatattataaattataactatgacttgtaaaagtaattattcatgtaaatataacaacaataaatcaaacacatgtcaacagaaataacatgtttacaaaaataactattttctaaaacaaattaaaatcaatgagaataatggcattgttttataattttgcaaatactttttatggaagacagcatattagaaggcaggtggattctaatgtttacttctgcattcaattctttgtgatatgtttttggttaaaatatatgaagaaaatctaggctcaggtaaatatatagttggaaaatggaagaacatttgaatagtcttttcagataattgtagatattattctttaatactacatcaaaatttaacagtggcagttagtggcagtttctttagtgaaatgggaaatctgaatctatattaatgaacttttggggctttgttatattaaaaccactggtcagtcttgtactttaaatggatttttccccaggcatgattttacaacattattcattgatcatttgacaaatattggttcactgagttatgcaaatcttccaatgttacacatttcattacacaatattctcaaattagttaacatcatgactggcctcatcatagaagtctattagcattggtaaactctcaagctcatggtggcagatacgtgttccaaaattctaattctaaattttaacattggcaagaaataccagttgttttccttaaagtcacaggctcactttatttttgagaaaattactgccaaatacccagtgacacagaatagccatagtttgtcagttgttccttcaagtaaaattggaatcctatgtaaaaagctgctagttcagtttgcaactcaaccatacaaatgctttaccttaagacttgcataggaggatgcaaggtttattgaaggatgaataccattgtccttcagtatgcatcagaagtgctttatgtgttcttcccatttgatacatagaacatttaaaaatgtacataaaggtcaaaatgtaataaactaataatagttactgacttataaaagacattactgagaatggctttttttcttaactgtgagtgtgcagcagtaaagaatacaattacttggaagagtctggcaattcctcagatgactaaacatagagttacatatgatccagcatttccactcctaggtatattcttaagagaaataaaaacatatgcccacacaaatttcatagaattattcataatagccaaaagatgagaaattcccaatatatatcaatcaataaatgaataaacaaaatgtggtatatctaaacaaaataaagaatataattactaacaaatacaatttggtgccactctcttaatttccgccaaggtaccagtggttttacccacagttgcttttgctccatcagtgaaaatgtcaacatggtgaaaaagacaaataacatattagaattaaattgttttgaccgctcagactccctggaagaatcttgggctcggagcccccggtgttcatggaccacacttagaatcactggtctacactatgcctgaaactctttcttcttttaccattatctttggtcacttcactggtttcttattgggctcagaccatttctctttgcattgtaaatatactatacgagtgatataatccacataaatggtttcagctaccacctataaactaataatgctcccaaatctatatctctaatgcagacttatttcctgacccacagatctttatttcttactgatatcctagatacctccaaattaatacacccacaatgtaattcatcttttctcccaaatttactcctgactttctcatctagggtattgatacctctattcatccagtcactggacctagaaatttagggatcaacctgaacttcttcctcttcctactcataaaatggtcagcccaggcaacatcaatatgtgatataatacaatagggtattgcagagcctaagtctaattggagaatgtatgttccatgtaagagcattcagattcaaatactgtgtgggccaaacaaaacacatttattagttgccagtctgtgacatctagtaactaaaatatctgtttaatttgtaccttgcttttcatttttagtgccactctcctaatttagatcctccatcatcctgcttggactactgcaaatagccttataactgatctttctgcctccatttttcacaaatcctttcccctttccaacacatccagatttatctttcacgaggcaaacaaagtagtctttctaaaatgcaaatctggtcacacatttgaaacgccagcttaaaattccaaaatagttcctaatcacctatttaaaaatccacattccttagcacagtgtaagcgtataatctgcacctcccaacttattacatcaacttggtttttctccactttcctatccacacaccaaactccagctaccaaactcatgagtggaggccagacttcttaatcattctcatgtgtcaggcactgttctaaattacatataccaactcatttaatcttcacaaccatatatggtaggtgtcatttctaagtccattttacagatgaggaaactcagacacaaagccacattgatcattgggaggtcattgacagtttttcctgattcaggattctgtgtctttgcaaatgctattccctctgactgaaattctttttgttctcttttctaacaaacttccaccatccttcaagactcagatcaaatatcattcttgagctaccttctcttgctacctccttccccaggtaaagaaaggtaggtattccttcccacatttagagcacaaagtacatattaaaacttaacagaaataggcacctgcctaaaatttagcacagcataacagtggcttaccagtagtatgcaggccttgctgtaagcaatatgctgtatcaagaactacaaattctactttttatgaaagagagagaggaagaaggtgatggtgagtctgttcttgctctcccttcctatccccactcacctcaaatcaccatcacatccctttggcagatagtcctttagagatgatccaagtaaaagccatcacttccacatgttggaagtgatggggtcttatctggggtcttaaaatctatgaggcttaaacccacttcataatccctcaataaggtgatgcctgtttggataattggaactgtcaaaatcaataagaaaagtttaaaaacagtcatgacaagccactctgaaatgaagaaacaactgtaagtcactgattactatgatttttacaaagaaagctatatcatctttcgtaaattgagcattaaggtataaaagctccttattctctaacacatttagagtttgaatacatgtaatccggcatcttctgctaggcagggatttaatgaacattttgtgggaacatctgtttgttatttatctttgtctcattttacacatcagcaaatcccattctaccaccaggacagaataaaaatcaccatttcattacacagtgttcataattttaaacgtcaactggggggaagagaggcaattgtcgacactgtattctacctgatgttacaaggagaaagtacaaaggtgaggaagtgcagaggggaaatgattaaatatataaatccctttaacacacaccttgccaattgctacttgttttactgttccagcaactgctgagaattaaaagccactctatctttctagaaggacattcttattttgccctcttaagtctatgtcaacctttttctgtgtgttttaagagagaaacaactattgggcttgccaggtatagatctttgaatatttgggaaacaagtgagagggagggagagagggagggagggagggagagagagggagagggagggagacggagagagagagacagagagagagagagagagcttctatattttcttcaatgttactattccattgcatgaagtcatcaaatagcatttctatatgcttccactagtcgttatgagaaagagccagtatcaaggccatcaggaatgaccaccagtaccatgagctaaggctagtgcaaagaagggaaagaatactgccaatttagtccaagtgactaaagccattactgtataacatatgcatcatagtatctacttgtaaattttgcatgttttaagttagatagtaatattgagtgaaatcttaattgtaacagtaattaaaggtgatttttccctaaatccaaatatattgttctatatgccatggagaatactaaacaaaggaataagaaagtcacagtccttgccttaaagaacttgcaatcatttcctcccaacagtcatttgtagtacatataaatcactagtcttctataagggggaacaagtttggcacatacaaactcactaaagaacaggagaatatataacgcccaatcaaacattagattgggtagtacagacaataaatactgctgtagttcaaagaaggggaaaatcaatgtaggctagcaaaagaagaggaggctttctgtgatgtacaggatttgagtcaggtgagttgaatacgatttacaaaggtgaagggcgaggacaaacaatcaaattaactaatattatgtgcctttatcctatcccaacactagagttctttcccacaaaagcattttgaaagtccctccccataataccatcaaacaggtaaagaaagagataaggagatgcacacatctcccttacaccttcttttctaagccaccgaggaacagaaacctcagttaggaatcgatgcagatatttgattcaagtaattgatgctaaaatatggttaagggttaacctcaccatgagacattatatcttaaaagaggaggtcatgaatcaatacagaatctctaattagtttaattatgtggaaaaagtatttttaaagctgggcaaacctcttagaaactttttcttctatttgtccattttagacaatggtgttccttccccacccactctgctagagcttacaatatgcaggatcactgggggtagcaaatgcctttccttttatgtgcaagaactactttacctcattgggctcctcagtttttggacatagcaaattgctaatactagaaaccatctgacaagttgttctaagtaagtttctattttcttcagcattagttttgttctgttttattttgtaaggcaaaagcacgtattaagctataggaacttatttaaggttgcttaaaaaattctcatggatgaaacagtagtcatttttatttatctcagtgattttcagctaggctggtatagcactcactgaagatcatatcagaatcttcgagaagtctttttcaaactatgtctccctatgtctaatattgcatgtttccgcatggtggcatatctcttctctacttgatttcagcatcagcctatgtttaatacttacaaagtattacttaccttcattcctaacctacctctgcatggcagatcatcatgctaatggaagcaatgaaggaaggaaagaaaaagaaggaagcaagaaagacaatcctaagcaaaaagaacaaagctagaagcatcacgctacctgatgtcaaactatactacaaggctacagtaaccaaaacagcatggtactggtaccaaaacagagatatagaccaatggaacagaacagaggctgcaaaaataataccacacatctacaaccatctgatctttgacaaacctgacaaaaacaagaaatggggaaaggattccctatttaataaacggtgttgggaaaactggctagccatatgcagaaaactgaaactggaccccttccttacaccttacacaaaaattaactcaggatggattaaagacttaaatgtaagacctaaaaccataaaaaccctaaaagaaaacctaggcaataccattcaggacataggcatgggcaaagacttcatgaataaaacaccaaaagcaatggcaacaaaagccaaaattgacaaatgggatctaataaaactaaagagcttttgcacaacaaaagaaactatcatcagagtgaacaagcaacctacagaatgggagaaaatttttgcaatctatccatctgacaaagggctaatatccagaatctacaaggaacttaaacaaatttacaggaaaaaaaacaaccccatcaaaaagtgggtgaaggatacaaacagacacttctcaaaagaagacatttatgcagccaacaaacatatgaaataaagctcaatatcactggtcattagagaaagccaaatgaaaaccacaatgagataccatctcacaccagttagaatggtgatcattaaaaagtcaggaaacaacaaacgctggagaggatgtggagaaataggaacacttttacactgctggtgggagtgtaaattagttcaaccattgtggaagacagtgtggtgattcctcaaggatctagaactagaaataccatttgacccagcaatcccattactgggtatatacccaaaggattataaatcattctacaataaagacacatgcacacatatgttaattgtggcaccgttcacaataccaaagacttggaaccaacacaaatgcccacaaatgatagactggataaagaaaatgtggcacatatacaccatggaatactatgcagtcataaaaaaggatgagttcatgtcttttgcagggacatggatgaagctggaaaccatccttctcagcaaactaacacaagaacagaaaaccaaacacgacatgttctcactcataagtgagagtggaacaatgagaacacatggacacagggaggggaacatcacacacgggggcctgtcagggggtgggggactaggggaggaatagcattaggagaaatacctaatgtagatgatggattgatgggtgcagcaaaccaccatggcacgtgtatacctatgtaacaagcctgcacgttctgcacatgtatcccagaacttaaagtataacaaacaaaaaaaaagaagaaaagcgaggagaaatttttaaaagctagaggcacatacagtaccagctttctacttgactaagctttcaaatcctgattgaatgctcttcattcttaaggactagctttctattctccatactctaactaagaagtgtgccaggctgtgtttgtcatgtcctagaaaaccacttggtaaatactttgttccatctgtaattgaaaaacacatgacctgacacttttgacaccatctaggggatagagtgtgagggaattagaaaggttctgcggatcaattgactccttggtagtaaagagtgggaagaaagggcaaaagccaataagccatcatcacagggttggcagcacaggtaatcacaacagtggaggggaatgggtcaactatggaaatcatgtggaactatagcttaataaccaagaagaagcaaatgcagaaactagtgcgaagcaagggaatgagatacagaagaaggaaagcaatgaaataaaagataatacccttttcaggtggaaaggccaaattcatctgtaactccaaaatctcaataagctcatctaaaaggatgaaatgccacaaagcctatttgtaacattctattccattatcaaaaggcatcttgctaggatccaaaagaaaaaacaaaaaacacaacaacacatatacacacatacttgtgcacctatgcatatgcacatatctgcatgcaaggattaaaacagaaacatgtagagacatacacacagccactccccgcccacacagacactaacaccaacacatgcatgccccccccgacacacacaaacataggcatgtgtgctcactccaggatgggtctgagtaaaaagaaaccatctctgacctagctaattttcttcttcaacttgttgttcttggcttcttcactcaggaataatcccaatcaaatgcaagaagtgtgtgagtcactaaacagggcacttaattttggttgtcttatattacatatttataccatggagattctggctactttttaaaaagtagttttaaaaggtataggtttggttctgaagtggtgttactggtgagaaagggtataggaaaactatgtacagagtcacctctcatgggatcttattctaagtgaggtgtgtgccttttaaaaatcagtcactctctataaattcagagtaattgtttttgaaatctaagctggctttttttttttttgcacaaattgacacactgattccaaaattcatgtacaaatacaagaaacccagaaaaaccaaaacaatcttaaagaagagcaaagttggaggactctcatttcctgagatcaaaagagtgtggtactgacataagggcaggcatatagacaaaacagtgtggtaacaatgtaagggcaggcatatagacaaaaggaataaaattgagtgttcagaaataaacacttatatttaccttcaattaatttttgacaagagtgtcaagaccacgcaacagagaaaagtggtttttcaaacaaatgatgctgggacatttggatatccaggtgaatactatagttggatccctgcctcacatcatatacaacaatgaactaaaatcggatcataggcctatatgtaagagctaaactttgaaattcttagaaaacatgaaagtgaatcttcatgactttgaagttaagcagtggtttattatatatgataccaaaacagaagcaacaaaagaaaaaaagataactgtgctttatcaaaattagaaatattttcagacaaatgatataatcataaaagtgaaaagaaggcctacagaatggtagaaagtattttcaaaaccacaataagacaccacttcacacctattagtataaaataaaaagaaaggcagacaataataagtgttgacaagattgtggacaaactggaatgcttatttattgctggtaggaccgtaaaattgtgcagccactttggaaaacatttttgccacctcctcaaaaggttaaacatagagttaccacatgacccaggtatatacgcctaggtatatatataccaaagagtaatgaacacatatgtccacatgaaaacttatacattaatgctcatagcagcattactgacaatagccaaaaatggaaataacccaaatgatgactagataaacaaaatgtgctatgtccatacagtggaacattacccaaccataaaatggagtgaaatactgattagtgatataacacagattaaccttgaaatcattatgctaagtgaaagaagccagatgaaaaaggccacatatttcatgattccattcatatggaatgtccagaataggcaaatctatagagggagtagattagtagttgcctagcactgggagttggaggaagggagtataggaaattgggagttaaaggctaaggagatctgggtttacttattttgggggtaacaaaaatgttctaaaattagatttttggtgagggttgcacaaccctgtgaatatactaaagatcactaaattatacacttaaaatgagtaaactgtatgatatgtaagccatacatcaataaagctgttaataaaaacagtcactcggagcacatgatgattgttttccagcatttgaagggctaccagttgcttggcatagcagcaaggggaagtagaatcagggtcaccacactacataactcctcaatttattctgtaggttgtgtggatggtactatgtctaagagtaggagctgaatagaggctgaaaagagattttggcttatttatgcaaacattcaataacttgagctattcaaaaatcagatttcctaccgtatactagagactgttaaattattgggagtatctaagcataaactggattgaccacttgaggatggagtagatatagggaatagattatgtatgaaagggagtgagggaaaatgacttgataacctttaaggtttcttacaaccataaaattcttttaaaatgcttatattacaaaatccttctgaacttttatctataaacctcccttttctctttcttaataattttctcattagctggaaataaatgagtacttacatattcccactagagtcataagtcccaatagtcgtattattatacgaaataataaaacttgatgctgtggtttaagccatttctaatatttatatgctgtttctggctcaatcatttagcaaagggcacatctactggattgctctttccttagtctgcaggtttaagggtagcatttcgtaaatgttagtaagaacaacatcctacattgtacttaacactgataatagttaatgaatacaaatcattccgtactcttttatctccttcctccctcttctgtcctttccccagatatggaataggcaggctgttgatttttacaagttgcttccaaagctcctgaatgaactatttgtctgagcgttttaaatattttggcttaagtccatgaatgccataagaaactggcactccattttgcaatgcttttctctctgtcaataactttaacttgggatcataaagggaaagcatttggcaggtggtccattatgatctagatttaaaacctcatggggagtcgtctactccattttacactttactgggaatgattccgatactgaaaagagagaagtacagatactatgagaaaagctgtttatccatcacctgtttcacaacagcaaggggcagtttactatcctgggaggggcagcttatcaatagtgccctgaggatcagaaatggctaaagagcttcaaatacttccctcactggattggtcaagtacaggcaacacaatacagtaggtgctagctaagtagtgctggctgacttatcctggctcactgacatgtcaaaaatctccaatggaaaacatctgcaatgaaattgtactcattgtccagctagtacaccagagccttactataaatcccaacctcagtgttcatgccttggaactgtgttctaatgttctaacatagcccttctgttacttccagtaataaatccatgtggagatggtccaagaagggcattgccttagatcatattccatgttagagtgaggttcttctctacagcttatgcttcatctggccttaatgtgaggccagccaaagaaatgttctggagagtttgcttcggggtggggtttccttttattttaactagctgttaatatttgacaaaacaattatgtccttctcacttcaattccttcaaaccatttcttctcagaccatttctttcccttcttgttaaatgcctcacaaagcccatgggtagggcactcagggaatactagttgagatggggagagacactactggaattccaggctcatccctccagtggtcatatttctgcctgtgcttattcctttttccgtgagactatgctctttattgctcactccattcaaaagagccgtgagtgccaatattcacgaactactcaagctgtctttatcatatttactttgtgtcctaccttcataaaccactctccctagattccttaagcatttcaattgctcttttccatttcaagcatctcagttccagagaatggaaacttgggcatagtcttactaccaattaaaaagggattctcactactatgctctaagttatttgtccatatccatgtcagttactcaaaaccatattggcttttaaaatgatgtatcacattgcacactcttaatatagtttactatcccctgtcacttgtagatgtataaaagcatgaatcaaaattacttttgatgttttatatttatttgtttgatatttataaccaagacgaaatgtaaaatgccacccataaaacctttccagaatagtctgatttacttgcagcttattgtcatttttattaaatatggattgtcacaattattttacgttcctcatattccttaccacaaattgaggtgaatgcagattgtacaacttccaatgaataagctgggcaaatttccatgactcagcagagtgtgtaaggcttgtggttctttgcaattcctgttccacctccaaaccccacggtcaaggtttgggaaaatgccaaccatgtttggcagcaagagtcagcagtctcttagactgctgggcaagcgagtggcaataagtagagtgtataaagaatctaaagaaggctttctttacaaccccttagtcagaagccctcttaaaacacatcccaattcctgttcaatacacagctagcacaggaagtgttttctttacattctcccattttacgcagatctgggatttttatgagggaacatcctagtactgataatctctcttctctcttcccttctccctttctctccctccctccatccctccctccctcccatcttatctcttcaacacccatacccacagagaaacagagtaagagaataggtaaccattcacaattatgtgtataagtaaaaagcaacaggaatgcaggctttctaagagcagtgtttctggagacagagctctagacaagttagtggtatatatagtctcggctaagaagaacaacttctttatcatttattgagagtactaacaaggattaaataaaataatttatgtaaatatcttagcatagtcctatagcatacctttaaaacatatttcccttcttctctactctggtttaaattaggaaggatcctgatcagagtgaactttttttactgaaagcagaaatgactggtttcctaaacaaagtaaaaatgtcactgaaaattgtagatgtagtctgggggaagggagaggcaagaagttaaaattttcctttagatccaaatgggttttctctttacacatttctcaaaactgtagctgcgatactgtctctttagtcctcaaaacaaaagaacctatatgcagagtgctccagggtggccctgagaggcactttgaaacacccgttttgaactcctctaggcagttcagtgaggttggatacaacaatgaattctgggagtgagtttgaatggtacaaaaaagctggggaggatgcctgctgtccattaaaaacagaaaacagagccaaagaaagtgaagaatggaaagagaaagaagggaatttcaggatgtgctaaaaattttagcaattgaaaagtatacaaagaactgggatctaggcaacagagggcaggtccagcaggcatagttacttaccatatagtttccatagataacaatagtcaaggacattactctatccatgtatttttttttcccagtactttagaaatttgacactgggttctttttaaagccaccaagtacaactaatatacttgatgaactccacacaataacaaaacataaaaggacctacatttatatctctttatgtacagactacattccatttctgatcaacttcttccaaagtattaatgctattttaaataacaaaatagtcctgaaaggaatatactactggttcaaaaaagatttactcgcggaagaaatggaagctgaaaagttgtgagtcatgagtggctaaggggttgaacaatccaaaagaaaatagtgaaagggactatgagagctaaaatgtataaaagtgtctatgacataaacattgaaggtaggagctcttctgattaactcaactttcttatccctagctcagaaatcaagacttaacagccaaccctcaacagcaagccaatatgagaaaaacagtactgatgagaaatgcagagtgcagctcgcatttaaatttagttgagatcataatttgtcaaatcccttctgaggataactcactttaggccgtttttaaaatttaaattatccataaaaagaaatgcttgtcctatatgtaaaaggaaacaacattccagtttgatttcctgttgatacaattatcactgtggccatctagacctgtaagagaattactccttctggatagccaaaccttcttgagctgcactgacggtactacatccagtagccacatgtgattatttaaatatccatttaattaaacttaataaaacaaaaaaattcagttcctcagttgaagtagccacatttcaatgctcaatagccacatgtggctagtggatactgtgttagatagatagtaaagatacagaatacttcatcatctaacacagttccatcaggcagcactgggttagatatcaggaaactaagactttcagtgttcgaacaaaatattcaaaccattttcaggatagtttttccacagtgtaattaatatgaatatccatagagaatacagatcagaatttagcatttttgcctttgaacagtggttctcaaaagtcattcatacaggagaattatctggggagtttgctaaatgcagatcactcagagtgattcagtaggtctgggatggggattcagaaatctacattttacacatgtcttaggtaacgctgtcacaggtaattcctaaaccacattttgagaaacactgtgattatgcatcaaaaattccaattatcactttacatataccgatttcttttcttgaatggtattaaatatgtgtacataggcaagcccttatcgctatacaaaagtgcaaaatgttccacaaaggcaaaagacagctttcaaagtatagtagctctgagcgaggatgagtatagaaaaaaaaaattaagaaggtacttgcactaggaaaaaaaaacttttgaacagaatattccagaatacctatgcaaagcagaagcaatttagccatccagcttcagaaactcatgcttcggaacagctcggaacctttagctagcagaagaggagaaaaacctctggtggtgcagctgctgaaggtctgaatactgcatgtgagtgctaactgtgtgcaagacaccaggttatgtgctaagagacaagtaaaatatggtcatgacttcaagaactcagtctattgggggaagacagaccaaaaataaatattaaatacagtagcaggtataatttgagtggaaccttaaatattgagcagctctacgatcgctggagataaggaaggatggcaattgaaatgtagagaacagtatggaaaggcacaggagcttgaaaatttggggtgtacttatgacccagaagtggtctagagtggcaggtaaataagatatagagagcgttgtgtagtgggagataagagtgtaagggaattctgagtgcctgggacaaggctatggatggccctgaatgtctatttggaaaaaaaaaaaaaaaagcaaaatcctttagaggatttttaaggagaggagtgataggataagatctgcatttaggaagaacattctaacagttaggcataaaatggagtcgggagagagtagacacagagaagatgtgtgatgtttggccatttggctgcatggaagaaaaattacactttggctgtcaatgtttcttgttgcaaaaagctgagaatggagagaagcaacagattatgaaagagaccttaaaagcaaagctgaaaatctgaagaaagaacatgagtagtagcaatgtttagaaattcctggggatgcaatgttccccttcactttgtcagtaaagactaccaacgatgggggttggaaagaaagtaaaaatttttaatagtctggtcagcagacagctctacactgtctaggtcttttgaagtcatgaacaatgggatatctgctccgggtagcacacaggtgggcaaacagtttctttaataaagaacccctaaagacatacagcatactccacagtggttaagagcattggctctgaagacaaacttgccatccaatattgattcttgctacttagtaattgtgtgacgtggtaggctggatacttaaactctgtatctgtttttctaacctgaaaatggaaatactactgtctaccttatggcattgctgtgagcgttgatgagttcatacatataaggtatttataacatgatctggcacagagcaagctttcaataaatgttagtttgttttttgttttgttttgttttgtttttttctgagatagagttttgctcttgttgcccaggatggagtgcaatggcatggtctcagctcactgtaacctctgcctcccgagttcaagcgattctcctgctgcaggctcccacgtagctgagattacaggaacccaccaccatgcccggctaatttttatatttttagtagagacagggttttgccacgttggccacgctggactcgaactcctgacctcaagtgatccacccccctcggcctcccaaagtgctgggattacaggcgtgagccactgtgcctggccaaatgttagctattcttattattgtgtttatatatggctggggagacacacactcaactgtactatgctcaataatgtcaatcagtatagtttagcagccccatttgcagtatactatcctacataaatagcatgccttaattattgtattattcataataagcatattaagtcctttttggaaaaaggcaaatatgaataaattttcgaatttgttaatattcttggtgatccccttaaataagctagtgcaagctggctccagcacaccacggactggtgtatactaacctttatattcccgtccatgagacctgcccttcactcctctaaaacacgctcataggtgtaccaaagaggaaaatccatcagacgactcaacttcagctccctgaacaaccagaacctacaaatctccctcttgaatttttcttggcctcaaacaagacaaggaaaaagtaactattttgtagatgaaagactttttctttagccaataagaaaatgtcaatttctttaaaagccccaataaattctttttcatttatattcagagtgcctattcctagaaaaaggaacacagtgagggatgttagccagagcttccaactacgtaggacatttgccacctgaaaccaagtttaatatggaacttccaatttcatgcctagtttgcccagttctccttcctctaatcctgatctgttccccgaagttcccacctgtattttttaagtgtcaaattcatttaagtctaaagaatgataaaagggcttcatatcatcctcctttcttttttgccagaaggaaataatatgaggacagatttactttaagacatgttaaaatataaagataccatcttagataagggtaaattccaattacatggtatctgagataatatattcattaccatcttaaagtctcataaacagattataacaatacttgctctatctctggcccattttcttatcaacattctcaaatgttcattgtcaaatgctgaagaagagttgtctatggcgtgaacatcgagtcattaatctagtacacgggacagtctctaataaattcagatataaaaatggccccttcaagaatgtttactgaaggggtcctaaagaaagttttaccagagagcttgtatgagccattcaagtagttgggttcatttgatgaattgataatgtggctttaaatagtattcctttcttcagtgggacaaaaagcattttttcccttaaaactaattaatttaaaattgagaaaccatttggaaattttaaaagataagaatgctgatctatgagagagagagagagagagagaaagagagacacagagacagagacagacagaaagaaagaaaagtgtgaacctgaattagctgtatattttttctgctgatctggacaaaatactcaaatttcaaaaacatatagcacttcacattcatagccagtatatcttaaaatacatatactttcatggaaacaatcttataagttcatccagtacaacagtacaaacaaactagctttttagaagagaaaatactccatactaaccttttggaatagacaacattttgcttccccaaaatttcacaaagctctactttcattcatattgatgtacacattaatcaaaacactagtgtttcttacacatctgtaaaattaatcttgaaatcacacacatattcaaataaatgctagactaaaaatagttttgaaaacatctctagcgtcctatccaagaatacatttttcagtaaatgaccaaatttatcctccttctctagtagcataagtcacatttacctggcacccatcaaccgagaggcagcctgatatcagggaggaaaaagcacagattctttaatcagataatgtaacctgtaagtttaggctgcacttagatggagacctcaggccagttactcatcctgagtctcagttttcttacctataaaatggagatcatatcactgacctcacacttactgagaatgaactaagaaagtatatattaaatcactgtctaaatgttttataccacatccactatcattcagtaaccaacaactacactaatattgtaatttttaatagagtaaaaccattaaggaattaaacatgtattcactattagcatacaaataaaatacagtcataaaagccacctagttagatttgaaattattcattaggtcactgtggaattgagagctggcaaggagataatgtcgtttttaaaatgtaaacatttttattagcagagagaagttcttcccagatatagtaattccagtagcataacaaagtccagcatttttcattgccagaaacttaaaccagtaacactggtccatgagaaatctctatttattcaacaaagcaatattttccatgtaaatctatttaattttatagtggagaaaataagacaatctctggttttaaccgtaagaaaaaagcctcaacaacttctcacattaaaatgtacacagaaggctcttctagagtcaagcatgcattggaatacagagaaaacatccagcaagcacaactttccaacacttagcagaaccaaccaaccaatactcaaagaagaaactgaagctataaattcaaataaatgggctgcagggagactacacaaacctgctgttgctttaattgcagacaattcaattcagcagctgttggtccaggcactaaggttcactgtatgctcttcaacgtaaccttgaaatattgtcactcactcacttctccacatcatctgcatgctgtccaattaatgaggagcgaaatcaactgtcaaaccacgcatcaaaatagaacatgatcttttagctgttaagcgtaggagcataatattttaagaataataaagcaacaatggagatgaaagtccttgacaacaaatgatattcaaacttatcaaaacaacgtggttgtaggaactaagcttctgttctgtgaagcaagaaagtgaaactttctcagggtttttcatttgcaagggacctttctgtctaactgctgtgtaagaagcctttcaaaaaacattcgcccatacctgatcagaatcttcttcattattatggaccattatgtttctgaaagcttaagagaatacttaagaaacacttttgatccaaggatattttacaatacagatggtttggggctcgtatttgtagctttgctgtttccagcacttttttttttctgtcaggagaataaacaaacaacaataatatataatgttcatcaacctgagttcagtaatgaaaaataactaaatttaccaaacagatgtgtcctggaatgcttcctgtttgaagtttccctactcttaggtatatcccaaatctatacaaccaattaacaaatacaggagttaataaactctagagaaacataacacactaagtgtttaaaaattgctttttgcttccaaagcactgtcttctgtgcaaacactctaagctatatcacatactaccagttgcagacataagacttgagaaattcaatacaagaatacagcagagaagcgtgcacaattaagggatcgggactaccagtttaacagaaaacgcagattttatacagcaatctgctacaaacattatagctgggggcaggcatgttttatgcagctattttgtttagctcattagaaccctatttgtccttcagtacagttgaactgaaggaaaaataaaagaaagaaatgcactttgaaacaaaggggaaattcagataaaacaaaacatactatacctgtatattgtaccaggaacattgtgacactcttcagggaactgtttcacgttgtatcctatcgtgagttattctctccttaccctcttctctccacaagaagaaaagccaaagcaccccaaacccccactataccctatccctaacccacccaccccattgaggaaaaagaaaaatagctataattcagcttagatctgacgcttctgtttagctcagctccagccgagcaactgagcttcagcaacggagcatagggaggaggattctgatgccagtagcacttccatccacttcacttacacaaaagcaggcagtggaaaatccaggagccttgaagacaagggctggaactggcttttatgaattgctattactgcatgtgtcaccatccatctccaatgacggacacttataggctgaattgggagtggagggggtggggtggaggaggttggagagcaggtggagaagcaattagcagtatgttcattggagaattcgttcgggatttcatacatcagtgcctaaagaaacagcatgcagttgacaaatcagaactttacgatttgcatgccttggaagaaatcttagctcacagctccaaacaaaataatgtttgcccactcttacagggcacagaaagtcacccctttgctttttctttcctctggctacccttattcctgagaaatcaacattcagaatgaatatttgctaattttccctaaagaattgtatttttaaaaggctggaagcaaaggaagtataaagaaattaaattctattgaacatgacatctcttaacacaaaggcaagaagctaattattttaaggcaattcttcatccctagtcccattccccaagcgcagctttcacacctataatcagtggatcacacaacttttgtccatatatttaacactgaaaaacaaatctatgtctacctaaaaatagttcagttaaaatgaaggtgaaaagccaagagctatgtgcaggacccacttcattaggtgacttgagaaagcactttacatgtaagtgcttcagttttactcatccactaaactaaagctcatttttagacggattttaaaattaatcacgagtaggaacaaaaaggagatagtgtctttgggaggaaacatgatacaaccgaaggagcactggggctgggtatcaggaaacctgggttcagcttccagttctacaactttctaactatgtgactctggccaagtcacttaacttctttgagcctaagttccctttatttgttaactggagataatagtacctatcctgactgtctcacaggattgctgtgaacagctaatgagataataggtatgaaaacccttttgtaaattgtaaagggttatacaattgtatgggattattactaccatgccctaaacaaatcttgccttaatgattgaagtgaggcacctctatcacataaggcaaataaaaagaaagaactaatataatttcatgaaacactgctcaattcttacaatttttaaattagacggaatcgctgtttgctcttaaaattctatagcagggaacgtttttgagaaaattttaaaataatacatcaaaagtttattaaagagactggagccctctaaattctctctttcctttctggaaagtcagtccatttttcttcatatggtctagcattatgtcccatctggaatgcaaactactagataatgagcatctccttttgttcaagctttctatttgcctgttacatcctcattgcccagtgtgttgggggaggattcaaggtgattaactaaatctaaatccacaaggtaaaaatccaaagttatgctttatgaggctccaagctgccttgatcctatgtatacagtgaccagctggcttcagctgggacacaattttagcacatgaagtcctggggtggccacacctggggcactaaatgatccaggcaatgtttggggatctttggttcagccaaatcccacatgtcctgatttccatctgtatggtggttcccaagtgtgtttgtccacatgaaccaaatctgaagcagccaaaagaaaggtgggggatagagcagggatatcagatgtcagctcctcttggtcccatccagtgctatctgtgccctcaaacaagtgcccatcctacttcttgtaagaagaaagaaaactttttctaattgcccctttgaacgtcattgctactactgaagatgccagtaaaatatatatccaaaatctatgttaagccaattgggaaaaggataatattaatcacataacaggtaattggtagctaagagcaagtgagctgctgaaagggggaaggggagaaaaagacaagagaggaggagggaaacagaggggaggggtggagaaaagagaaaatgaatctaaagtgagagctttctaatcagaaacatacttgctgaaatcatccaaagtctcacctactataataaaaagtgcttgtcttttgaggtattgggagtggccccctaaccatcaaagctgcaaacctagccttccaactgcttagggaaacagtcaagagcctgaaaaggtactgacagccctagcaccagatctcactttcctctgccattcagaaagtgagtcaggtgggatacaattctccagaggcctcatccctgctaccgtccaccacagcctcactggcagcatggctgcccactaaggaaggtgtcagtccaatttcaggttcagcaaaggaggcttgcctgtgacttttaaaaccacattggtaagaaaggaacaaaggctgtatttcagaataggactgttctccctttgggcattgcaactaaactccttcacaaatttaagcttgaaattcatattccccaagttcctcagaagggccattcaaagtaaagggaaaggacaggaaagatgattttttttttgttagcttctttctgacagtcaaaaaatgaggaatatgactgacagagtgtcccaaaaggcaatgaggtgggaggcagtagtttcaacccaggttagcaagaagggcaatgaaagcatccttataaaaacaaacacgcataccaaaaaccattgcactgtttccattatcccgatttcaagctccagaatgtaagcactaatggttccctaaaccacccaagctcctcctcggcagccgtcaccaagcctgactgatttttttcaaatgaatttccatcactagccaccccagattctgagtatttttgtcaaaaacaaaagtcctagtggaagatttcaaagaactaagaacttgaaccaaaccatgaacttaaacgggaagacacagaactaatttgctaaattccaaacaaaacagaaattgtaacagtttgaaagcaacaaaaactagcaagctgatttgaaccagaacaaagtttcatgttttctgaatcaatcaaacttgcaccaaaccctgagagtctaatcagctcaagctcctgcaaagaacacacagcaaggtttggtttcacctgtctgaaagctgacaagggaaccacagaatgaacactggataaggagtcagaagaactgacgtctcctgattttcttcactgtttgatcttggtcaagtcacttctactctcttagcctcagcttgcttgccatgaaatggccaggctgggattgccaatatcccaatatcccagttttaatagtctatgccaactgtggaatttagtctagtgatgaaacagataaagtcacaatttagccttaatctgcaggaggcagagagatggaccaccccaactcttttaaggattcatgtttctagcttattttgaaatatacttggccgggcatggtggctcacaccaataatcctagtactttgggaggcccaggtgggaggatcacttaacctcaggagttcaagaccagcctgggcaagagagtgagatcccacctcttaaataaataaataaataaaattttaaaaagttttttttttaaaagaaatacacttcatttaagagttggtaactgtccttgttcagcctcagaaataacctaatatactttttcagaatgtctctcctcaaaaaaatgtttcaggaatagtttgttttcctcaagtgaaagttacagatgagttgtttggtccaataaaaggaaaaggaaagaaatgacagtgatctagtataggctgagcccctattacatgtcagacatggcaaattttacataattttcttaaccaatcttcacaatacaacactatatggttttttttttttttttttttttttttttgagaaaggatcttgctctgtcacgcaggctggagtgcagtgacacaatcatagttcactgtaaccttgaactcctcggctcaagtaatcctcctatagcagacacttttatcctcactttataggcaaggaaactaaggcttactgatgctaagtgacttgcttacagtacttgactggtactgggattcgaactcaggcaatttgaatccattactataacaatatcttaagaattaaaggaatagttcttaattcactgattcaattggacttgcttagtgaataaattacatgctgattcaaaacagtgaaagtaaatttacttgcatttatactgggttgacatttttttaaatttcattttacagtttggtataacggttaggaatactgggctctggagtcaggcagacctgaatttcttgaattctgtcttatggacaatacagttaaccatgctttgtctcaagttttcttatctgaaaaatggggaggaagtagtccctaccttgtcaggctgttggaaagtgtcagtgatctgatagcatctcgcatagtacttgacacaaaatgacaactcagtaaagaccgatgaaagctatccttgtattcacagcaatacaagaaagaaaaggttataaaggaaaacgacactgggattcactgaatttaagtgctctttggttatagcacagatatagtttggaaggttttcagtggtctccgtacattctccaaaactaacttgcatcttatggtaaatcagcatattcatgaagcaacatgaatacattaattggggtttcctaaagagtagcaaggaaacttgtcatgtgctctgcttagcagcagttgtccctagtttcctggaacccatccttttaaagaaaaagctcggaagtagcagacagtactgctggaagtaccaggcaggtggagacatcctgctttcccccaattcttcaagccctggcttctttcctattcacctgtggccctcttctcagattcccttctgtccttccccagtttattctggttttatcatgattcttcctctggcactagctctgtttctgctcatcagcatcaagtgctgtctatggaatgtgtgccttgcacgacactaggtgaaatagaaagtcatccaagagttaatgaaaaagacatgtgatccatggccaaacagatctaagatacacagactagagttttggcaacacagtaaatgcaggtataatgcaggatgacttggttgatttcagagcacaaaagagtttgttcatctagttaatgatatgcataaaaaaattttttaaaactgtactaatgtctgccacttaatctgaaatgcagaaaagaatggatagattaataggtgataaagcaaatacaacaaaatgttcattgtagaatctaaatggtgagtatctgggtgttcaatgtgcaattcttttaacttttctctgtatttgaatattttcacaataaaaggttgacgaaaaggagagggggaaaggggtatggcttattcaaccacaagtgtttcagaacaaaataattataattatatagaaaagtataaagcaaatagggcaaaataataacaattggtgaatctgagcaaatggtatataagaattcttatatgatgcttgcaatttttctatatttaaaagtacttcaaactagaaagttaaaagataatttgttgagcaccaacctcttttacctagtgtctcagttgccattttcagtagtgagggcattgggttaatagtagagatattggaaacaatggtggaagggtggggaaaaataacagtcacagatatatattgggggcctactatatgcaagacactgtgctaggcactttggggaattcaaagaagtaaaaaatacagcccctgagagggctcccactgtaagtaatggaatgccaaagcagtgtctgaaagggtaactggctggagcagagttctgtaagacagaagtacaaagattagaaaggtaggttggagccagattgcagacagtactaaaggtcaggctgaagagtttggacttcatcctatggataatgggaagccatttacagtatctgagtcagggaaagaacatgatctaaaactgactggctagatggtacaatttgtttgggcacaggtaccttcaacatgcatttgttttatattcatgtacatctggtacgtctatccacttcccatatctggatgtgacgtttaaggatttccaacatgctggttgctgcttatttttcaaatagccacttcctgacatctcttcagcctttcctttttcctcccccaaatcccaagggcagctgaccagcacgtgcctcagccctgctgactcagcaagcaataaatacgcctcatagaatgcttttgaaatgaagctgctgtgcttcaaaactgatttctttccttcatgataatcaaacctcaattactgctggaatcactgatttgagttggaaagaatgaatattcatctgagtaacatgtgaaggagtgcaggaagttatgtcctgtgtgcagaaggaaacaattgttcaaagtgatctctgtatatggaaagaaaccctagcagagatggcattgctgaatagtagcaagtgattagggtaaaacctctcaaagactgccaaattagaaagtggactttataatcctttggatatacacccagtaatgggattgcttgggtcaaatggtatttctggttctagatccttgaccatggcacatgtatacctatgtaacaaacctgcacgttctgcacagtatcctagaacttaaagtaaaatttaaaaaaaaaagaaaaaaaaaaaagaaaatttcctgatgtctatgatggtattgtagctatatatggaatatccttttttttttttttggtagaagattcaaataaaatattcagaaatgatgaagcatcatattaaaattttattctcaaatggttattttaatattctttataccattctttcaacttttttctaaattgaaagtatttcaaaataaaaataataaaaaaaaagaaagtggacttcatctgtcttcagcttttccccccatgaagtccaacctccagtgcaatcatgttactcctcccatttaaaaccctgtgttcactcatccctacatataggacaatggccatacttcttagcaagctgacttacttcacccaaccagccacaggatacctttccagactcttatcctgtccccctttcccatgctttcagtggttcacacacaatatcttacctttttctgaactatgcagttttacacatttgactgccttgcatgtgttgatggtccctctgcctggaatccttgcccatcacctctttgtccacatagagactaggcaatgcccctcatcctttatgattcagcacagttagactctgatctctaagttgtccacccccagctgtaattccctcctccatattcccagaacaccttctctctcttttgggtgcttttcacatcaaaatacgatcactggtttgagtgtctatctcccctattagactgtgagctccttaagggcagggattacatcacatcaaattcattattatagtcctggtgtttagcatagggtctggtcctgtatatatgctcaaatgtctattgaatgaatgagtttgaacatcaagtactccttgaagtcaaactcagcatctcttgaaaggtgaaaattagaatggtatgtgaccagagtaatcctagtgaagtatgtttgaggacctgactgaagaaaagctgataggaggacaccttatgggggcttattgtggggcagtttctatcccaggaaactcttattagcagttgttgctggctaaaaatgaagagcagctggagcagatgacaagggcccttactggggatttctccatccttatctttcatagttcaccactaaagcaatgttgttctctgaagtaacattttccatagtgtctcaattctcctgaatgattgccatattcatttgtgctctgcctaccgaggcatttggaccagctttgttaaagtgtggtcactgaaagctctttgattcttctactcacctatcgttattatgctaaagaacaacattttgtgagtaagagaccactgaaaaacagagcaccagaaaggggagggaagcagagctaataaaaattatcttttttctcctcctagattgccaatgtatttcaccatgtttccatcctacagtgttttatactatgtatcagtaaaggcaaaaaaaggaaaattaagacttcagcaaaactttacactttgtaggcaagaaaaaaaggaagcaacactgagggatagaacataaatctttagacatatgatcagtagccatttctgaaaagtacacatttgggctgttttaaacaaatagcaaaaagcaattaggtctttctgactaaactgaggtgtatgctgatttctttttttaaactaagtctgttttgatcttcaaaaatgtcagactggtaaacactttacttttttgcacatataaatctaagagccaagcctagcttgaggaagatttaagagacataaaatttgtctgaggtgtctgccaaatctctacagcagagacagaaaccctggaaaagctgacacaatcataactctcacatcaccagcaggcttgtgcagggctgggaagcacagaaagtcactgttccttctctcatactgtttgtaaacagagaagcagatcatttgcttatcagctatctggtagctcatttttgcctagctatcccactgagaaaaaaaaaacaaaaaaacacacatccccacgggtacatatcccagttttcagctgggtgaattttcatttataagatgggcccgcttgttaaaattttctcttttatttgctcttgaattctcttactcttgtgtgcttgcttgctctctctctcccttgttctttctctttttatacagaaggcattaaaaggggtatttatgagtatctagtgcagtgcctaacggagtgctttcacatagtaagcctacaataattcatcgaatgaagtgaaaccctatctgtaatttctacattcaaattatttgatcatgtagcaggaaaactatagattttttttcctggagtatttaaaagtaacaattccttataaagaaatattttactcagatgactcatgcttaggacttccatcccttagaaatcatccatttttgcacaatgggtattatctgtaaggaaaatgaagggaagactacacttcaggatcctgaatgaccactgatacgttattgtagagaaaatcagatatcctatatacactcgactgtatgtcgtatggtaatccactacatatgtctaaaatcacttaacaatgcaagaatatagtgcacacatgggctgcgttctgtaagtaggattaactattgaattcaaccaaggtcttccctggggacagattgctggaaaatacatctacatgacatttaaaaaaataaattaaccaatgacatcggctcccatgagacacattgtttcttgtacattcaattctatcacggttttctgtagctctctgttgacatacccatcccaaatgacacagaatttcaaaaaataaagaaaaacagagcaactggagctattccatctctcctgtgtgaagtgttatgtacacaaaggaaagatttccgtacatgagcacaatgtgaaccacgacagggtgagatcatgtcagttggctgttcttgttatgctgtggtcacatataacttgcccaagggagtgtacaaagcctgttttcttcctgacaaggaccagcagggattgctggaaaataaagaaaacagagttatggcaggaggttttaaattttctctttaaaaaatgccctttattatgataacttttcttctcgctttgatgtatttagttttcctcatctgtaaaataggaataactattttatgtgtttaatatttttgctctgagaattaaataccagtagattgcctggcataaaatagctaatccatacagtccacatcaacattggctaacattaattaaatacctattatgtgcctgccactggccaaagaccccccaaaaaagtaaatcacagaaggaaaacctaatactagaggagcaagcagggagctgattttcaaagcttttatcaggcagtctaagaagtctggatattactctgaagacaatggacagcctttgaactattttatatagagaccagatggttttagatttgtgatttacaaaaatcattctgtcagcattggtaaagagtagactagaagggaagcaggctggaagcagcagtaatccaggctagaagtgatgcatgtgtgttggggggtggaaggtatgccccaaagtaagacaatggtggacaccgggaaaacattttaaaataactttttttttttttgagacagagtctcactctgtctcccaggctggagtgtagtggtgcaatcttggctcactgcaacctccgcctcctgggttgaagcaattctcctgcctcagcctcccgagtagctgggattacaggcgcatgccatcacgcccggctaatttttgtatttttagtagagacggggtttccccatggtggccagcctggtctcaaactcctgacctcaggtgatccgcctgccttggcctcccaaagtgctgggattacaggtgttaagccactgtgcctggtcaaaataactttttaaaaattaacaaatatactgtagattagaaaataaaaatacgcaaaaggttaaaagtagaagtcatatgcaatcttactacttgcagcaaacccctattaatatttttttgtgtgtttaccattacaggatttttcctatgtatgcctacacagatgtgtgtgtgcgtgtgcgtgtgtgtgtgcgtgtgtgtgtgtgtattatgtatatgtttttaaactgggatctgtcactctgtactgagagttctatgatgtgaattttctcttaatatatcaaaaacaattttccacatcattaaatattgtttggtaaaatcaacttacaaggctacttagtaatccattctataaatgtaccacaattgatttcattcaaatccctagtattgtacatttaagatgttcttttttttcttttttttttttttgttgtttttgctattagtataaacaactctgggatagatgtcctgagtattaaatttttggaaacatcatgattgtttcctcagcatagagctctagaagttgaagtggtaggttaaaagctgtattctattaaggtttctgatacatattgacgaattgctctccagaagagctgtatcaaattatagtcccagcagcagagtctatgagtaggagatgaacttgagagtgatgtcaaggacggagtgtactggacttgggtgggtagaaggaaggatgtttcctggcaaagtatcagggcaggaggaagatgaactctgtcaagagcagcaaagtaatgggcagggctaaggaataggtgcctggataggtaaatgataggaaagaaaaaggtaagataaccaggggagagtgaagaaaagagggaaaaagtaggtctttcatgaaattatgggcactttaatttactcctttcttcagcaaaagtagcaaatgtagcaaacagctagtcttttcatagcatttggcactctgtgctaccaaggtccccagttatattcatgcaaatctgtttatcaattcttttcacccaataaccatttattaggtgactaccatgtgtcaagtgctcttctggatgctatgggtatggagatgaatgaaacctggtccctgccctcaaggagttcacagtctagtggggaacacagagacatccacagaccgacaccctacagtgtggtacaggctaggacggaggtaactaagtgcagggtcctgtggaagcccgaggcctaacattgccttgtgcgtgcattcatgtatgttgggcaagggctgtcgggaaggcttcacagaggtgttgacatatgagctgagtcttaaaggctgaggaatttcttgcatgcctaagggtcacagatcatggtcatattcctaatcagtgccttgaatatttgtgctactgctctcaaggacactgagtaaggtgggaaggatgtttgtgtgtaatccaaatccactcgagtggtaactatagcttccattgtaatcttaatgaacatagaaacatagcatgttttggcaatattattgctcaccatacaatataaaggacaagaggcaaggggggcatgcagacttttaaaacaattctggtaacactgacaaaataatattaacatccaccaagtcctaataattttacctcctaaatgtttctcaaatctcttcgctccgctcacgtcactactcttgggtctttattgtctctctgtggaacagagtagcagcctcatcatatccacctccactgtatccttcccactgtcattttccttacagtaaaaatctgatcgtggtgctcttctaaaacatgttaatggtttcttatggcctacaagcagcacttcccaaatttcagtctgagtattacttagtgatttttaccatattcacacacaatgtgtactattactacttaatatttgtctttaaatgaactgaaaactggttcactttctatttttatgaagtaaaatccaaagtaatcttagatgtgatggcttagttcagttttatgttttttaagacatatttgaacatgtaactagtaaaattaaaatgtttgtgggagcacagtgtaactaccactggcagatgccctacgttttgagaaccactgacctatgggggcacattccaacttaggattgcaatcaaggttctttgcaaatcagccccaacctctttccagactcttctcctacccattacagtttccttttactcaactatctgcactccaaccatgctgaattcttccacattgaatgaacatgccctactcttatacagccacacatctttcacagactgactcctctatctgaaatgcctcccctccactccttccctgcctggggcaaactcactatccttcaagacctatctcatgtcacctcctcatggaagccttctccccgagtctcccttacagtgagtcacaccttcctttatccctccatagcattttgtacctgtctctgttatactacacactacagtatctcagaactgtgggcatccagctccccagctagaccccaggaagagttcacaccttgtacttcattgtttctccaacacttcacgtgggcagaggtcatgaaagagatctagtgtcccaggtaacttcttaaaatgctaaaataaaatacatccaaagtgctatcaaggtccaaatagcttagaggtatgatatgtgttataaagagaatcatctaattcagaaatagccgtactgactatggttttggcagacacaattagctacagttgcaatgacagttaatttggttttggcagctactttacagcaaatacattctgacatagaaattttaagtgaatcatttgggttttggccaggatgatgaactatacctatctctccttaccacaactggaaagtcaagaacaagaaagaacattgggagcagcaaaccatgttgaacagagcatgggctttggagtcagaaatctgtacacccaaacctcaactcaacttataatctatgtgactttaagtagattgtttaacttctgtgcattttagtgttttcttctagaaaaagaaacaggaataatagtacctacttcataacactcaagataatgcaacaaagtatttatgatgatgactaggacattatgtgggttcaataaatagcagtcattattgtcacccaatgagatgactacagttcagataatgtgatgcacggggacagcaaatgcatttcttaagaaaatatatcgatgtctctaggctttaaagttgacagctatagactgtagctaagaatagctacaaacaaaacatctgcaagacaagcttcttcttggatttaaactcacacctggaacataccatcacacttctttgtgttctccaagaattgatctcaaatcaggttccctaggatgaaaagaaaaatcatccaatcttaatttttgccttcaattttatttgatacagaataatatccaaactatgtgtatgtttcaaagtatcatgttattatgaccccaagcttctccaccctatttatttcccagtatatttgtgctgatatcttttattccaatcaggcaagcccacctgtctcacagtgctccctcttctgtttacccttctcaaagtccaatctcagtagcaggaagcattttctccctcctctttgacaacttcaaatcccctgtactctgctggagcccagattaaaattcacctccttcacaaagcctgaaagccggatgagggcttcagcacttcccgggttaggcttgaacttccatagatgaactcaccacccccatcagtatgctcttccactgacccctcttagcgttttttgcacacgtttgtaataatacaatgattaatatggtctgtttcacacggtctactttattctgtagaataaaggtgtgccccctaaatgtttgtcaacattagtgctatcagtctttgctggaaacccctaaagcgctggatttttataaccagtctaacttgccttttactctcaccagaaccctgcactgaaccttaaacacacatttctcaaaagcaagattccttccctcttttgcttcccatcccttctagaaattgaggggaaactctccccacttcaaagacctggtgggggaagtggcaggtggctgaggggccagtaaagagatggcgatcaattaaggaggcaaaaagagaaagtttgaaaaaaaaaagtcacgccctgagcgtggcaaggaattcccatgccccaaagaaaatggggagtgtagcgcagggagggttatgtgcccaaacctgaaatacaaattgagggaaaagaggaaagagatcacccaattcctgcggtaagaattagagtccagtcaccgcctaggcaaaaccctggacgcaaaccccaacttcggacctctgaggaggcacagagccagggggaggggggcggcgtcgtgggaaaaaaaaaaaggggcgggcgagttggaccaaaaaaaaaaaaaaaaaagagcaaagacagcgcgctcccgggctcaagagaactggcgcctagagctcaaaagcccacccccgactcccagtcccgataccccctcccctgcagaggtggagctgggtggagttaggcgctgaggaccgcggccccggaagcaccctcctccctaggccccctcagtcccacagtccccagccacggccaccggggctttctgcctctctgacctccagctccccggctaccgaagcgctagtccttatacagccgcggaaaatcgggccggcgcggcagttcctgggctcgtagtgccctcgcggcgccccacgccgcgccactctcttccgaaatgcccgcctcgcgcttccaggcctagacccggcactctggcccaaggctggactctcacacac

SEQ ID NO: 1042 - DNA, 279852 bp, Homo sapiens; identical to SEQ ID NO: 1041

SEQ ID NO: 1043 - DNA, 301839 bp, Homo sapiens
  source (1)..(301839): Reference sequence from hg18
ccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaaggaagtaatgacttaaagtttcagatattctttgtgtatttattgtctgttgaggaagaagaaaatatagatgatcattgagcacttgtgaatacaaaaaatacttaaaccaaacttaacttttttcaaaaaagaatgacttaaagttgtatgtcaccatttaatacatatcatagggaaatgggaaaggtggtctttactcataaatacatgaccgagagaagatccacatataaaattccctgccctcttctcctccttcttttgactgttgtctgcagatgcttcaaggaagtctactgaaacaaatggcggttggaatatatatgcaggtttagacatggaggaaggaacagtagctataaaacaagaactaagcttattctaaaattttgccaccaactccaaaggtagactgaagtacaggtagtttgcctgtttgttaaggagtgatatttattttccattcttcacatctcagtagagtgtaaataaaagactgatattttgaaaaggtgaacaaaattggcaaacctttagccaggctcattaagaaatgagagaaagaaagatgacataaatcaacaaatcaggaatgaaaaggagacattattacagacatgaaaaggacaataagaaagattacaaacaactttatgcccattaaattgaagacttagatgaaatagacaaatgctttgaaagaaactaccaaagctcacttatggaatagatatattcctttaatataatttatgactgagtagtcataaattacttttaaaaatataatttgtgttaagaaccaacaaagaaaactctagccccagatgcctttactgtcaaaatctacccaacattgaatgaaggaataataccagttctacacaaactttacca

SEQ ID NO: 1044 - DNA, 301836 bp, Homo sapiens
  mutation (266472)..(266472): g.266472delTAA
ccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgacttaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaaggaagtaatgacttaaagtttcagatattctttgtgtatttattgtctgttgaggaagaagaaaatatagatgatcattgagcacttgtgaatacaaaaaatacttaaaccaaacttaacttttttcaaaaaagaatgacttaaagttgtatgtcaccatttaatacatatcatagggaaatgggaaaggtggtctttactcataaatacatgaccgagagaagatccacatataaaattccctgccctcttctcctccttcttttgactgttgtctgcagatgcttcaaggaagtctactgaaacaaatggcggttggaatatatatgcaggtttagacatggaggaaggaacagtagctataaaacaagaactaagcttattctaaaattttgccaccaactccaaaggtagactgaagtacaggtagtttgcctgtttgttaaggagtgatatttattttccattcttcacatctcagtagagtgtaaataaaagactgatattttgaaaaggtgaacaaaattggcaaacctttagccaggctcattaagaaatgagagaaagaaagatgacataaatcaacaaatcaggaatgaaaaggagacattattacagacatgaaaaggacaataagaaagattacaaacaactttatgcccattaaattgaagacttagatgaaatagacaaatgctttgaaagaaactaccaaagctcacttatggaatagatatattcctttaatataatttatgactgagtagtcataaattacttttaaaaatataatttgtgttaagaaccaacaaagaaaactctagccccagatgcctttactgtcaaaatctacccaacattgaatgaaggaataataccagttctacacaaactttacca

SEQ ID NO: 1045 - DNA, 301839 bp, Homo sapiens
  mutation (1005)..(1005): g.1055C>T
ccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgttatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaaggaagtaatgacttaaagtttcagatattctttgtgtatttattgtctgttgaggaagaagaaaatatagatgatcattgagcacttgtgaatacaaaaaatacttaaaccaaacttaacttttttcaaaaaagaatgacttaaagttgtatgtcaccatttaatacatatcatagggaaatgggaaaggtggtctttactcataaatacatgaccgagagaagatccacatataaaattccctgccctcttctcctccttcttttgactgttgtctgcagatgcttcaaggaagtctactgaaacaaatggcggttggaatatatatgcaggtttagacatggaggaaggaacagtagctataaaacaagaactaagcttattctaaaattttgccaccaactccaaaggtagactgaagtacaggtagtttgcctgtttgttaaggagtgatatttattttccattcttcacatctcagtagagtgtaaataaaagactgatattttgaaaaggtgaacaaaattggcaaacctttagccaggctcattaagaaatgagagaaagaaagatgacataaatcaacaaatcaggaatgaaaaggagacattattacagacatgaaaaggacaataagaaagattacaaacaactttatgcccattaaattgaagacttagatgaaatagacaaatgctttgaaagaaactaccaaagctcacttatggaatagatatattcctttaatataatttatgactgagtagtcataaattacttttaaaaatataatttgtgttaagaaccaacaaagaaaactctagccccagatgcctttactgtcaaaatctacccaacattgaatgaaggaataataccagttctacacaaactttacca

SEQ ID NO: 1046 - DNA, 301839 bp, Homo sapiens
  mutation (1695)..(1695): g.1695C>G
ccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgcggggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaaggaagtaatgacttaaagtttcagatattctttgtgtatttattgtctgttgaggaagaagaaaatatagatgatcattgagcacttgtgaatacaaaaaatacttaaaccaaacttaacttttttcaaaaaagaatgacttaaagttgtatgtcaccatttaatacatatcatagggaaatgggaaaggtggtctttactcataaatacatgaccgagagaagatccacatataaaattccctgccctcttctcctccttcttttgactgttgtctgcagatgcttcaaggaagtctactgaaacaaatggcggttggaatatatatgcaggtttagacatggaggaaggaacagtagctataaaacaagaactaagcttattctaaaattttgccaccaactccaaaggtagactgaagtacaggtagtttgcctgtttgttaaggagtgatatttattttccattcttcacatctcagtagagtgtaaataaaagactgatattttgaaaaggtgaacaaaattggcaaacctttagccaggctcattaagaaatgagagaaagaaagatgacataaatcaacaaatcaggaatgaaaaggagacattattacagacatgaaaaggacaataagaaagattacaaacaactttatgcccattaaattgaagacttagatgaaatagacaaatgctttgaaagaaactaccaaagctcacttatggaatagatatattcctttaatataatttatgactgagtagtcataaattacttttaaaaatataatttgtgttaagaaccaacaaagaaaactctagccccagatgcctttactgtcaaaatctacccaacattgaatgaaggaataataccagttctacacaaactttacca

SEQ ID NO: 1047 - DNA, 301839 bp, Homo sapiens
  mutation (1845)..(1845): g.1845T>C
ccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatatcaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaaggaagtaatgacttaaagtttcagatattctttgtgtatttattgtctgttgaggaagaagaaaatatagatgatcattgagcacttgtgaatacaaaaaatacttaaaccaaacttaacttttttcaaaaaagaatgacttaaagttgtatgtcaccatttaatacatatcatagggaaatgggaaaggtggtctttactcataaatacatgaccgagagaagatccacatataaaattccctgccctcttctcctccttcttttgactgttgtctgcagatgcttcaaggaagtctactgaaacaaatggcggttggaatatatatgcaggtttagacatggaggaaggaacagtagctataaaacaagaactaagcttattctaaaattttgccaccaactccaaaggtagactgaagtacaggtagtttgcctgtttgttaaggagtgatatttattttccattcttcacatctcagtagagtgtaaataaaagactgatattttgaaaaggtgaacaaaattggcaaacctttagccaggctcattaagaaatgagagaaagaaagatgacataaatcaacaaatcaggaatgaaaaggagacattattacagacatgaaaaggacaataagaaagattacaaacaactttatgcccattaaattgaagacttagatgaaatagacaaatgctttgaaagaaactaccaaagctcacttatggaatagatatattcctttaatataatttatgactgagtagtcataaattacttttaaaaatataatttgtgttaagaaccaacaaagaaaactctagccccagatgcctttactgtcaaaatctacccaacattgaatgaaggaataataccagttctacacaaactttacca

SEQ ID NO: 1048 - DNA, 301839 bp, Homo sapiens
  mutation (113001)..(113001): g.113001G>A
ccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatgatattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaaggaagtaatgacttaaagtttcagatattctttgtgtatttattgtctgttgaggaagaagaaaatatagatgatcattgagcacttgtgaatacaaaaaatacttaaaccaaacttaacttttttcaaaaaagaatgacttaaagttgtatgtcaccatttaatacatatcatagggaaatgggaaaggtggtctttactcataaatacatgaccgagagaagatccacatataaaattccctgccctcttctcctccttcttttgactgttgtctgcagatgcttcaaggaagtctactgaaacaaatggcggttggaatatatatgcaggtttagacatggaggaaggaacagtagctataaaacaagaactaagcttattctaaaattttgccaccaactccaaaggtagactgaagtacaggtagtttgcctgtttgttaaggagtgatatttattttccattcttcacatctcagtagagtgtaaataaaagactgatattttgaaaaggtgaacaaaattggcaaacctttagccaggctcattaagaaatgagagaaagaaagatgacataaatcaacaaatcaggaatgaaaaggagacattattacagacatgaaaaggacaataagaaagattacaaacaactttatgcccattaaattgaagacttagatgaaatagacaaatgctttgaaagaaactaccaaagctcacttatggaatagatatattcctttaatataatttatgactgagtagtcataaattacttttaaaaatataatttgtgttaagaaccaacaaagaaaactctagccccagatgcctttactgtcaaaatctacccaacattgaatgaaggaataataccagttctacacaaactttacca

SEQ ID NO: 1049 - DNA, 301839 bp, Homo sapiens
  mutation (227364)..(227364): g.227364A>G
ccacgctggagtgcagtggtgcaatcatagctcactgcatccttgaactcctggctcaagcaatcctcttgctttggcctcccaaagtgttggaattacacgcgtgagccaccatgcctagccttagcagtccatttctaacctctttacaacaatctccttgccattctcccagctaacttctacacattattcagattcagcattcagcttagatattacctaatttagaagcttcccctgattgaattgagtgccctttctttgtatcactttgtcctttctcctgtatccctcaatgcttttctcctgtacttatcatattataccgcaattttgttgttaacttattctgtcttttgcactggattataaagccctttagtggaggaattatgtcggtctcaatgctgaatattttaagtctactgtagtactcggtacatagtagttgctcaacgaatatttgttaaataaatgagtcttaagtctggaagaacttgcaaagttctttaccaggttgctggtaaagcaacctgacctttctttcagggaactgtcagcaacacaagccatgaataccaacgcaaaacagactctcactgtagatcacacgggaaaaaataaaataaaaaggtaaaatccttaacggtggtagtatttaaatgaccatatactgcttagtaagaaatcctggggtcattttcaaggtcccccatttcctacttttgttaagctgggtcaagtctctttaaactttctccgttttcttgtccataaaaagagtatactaggtaagtcttctgtctacctcgggacttctgtaagtatcataagagatgttttatatgacaacacttcacaaacgtttagtaaaacgctgcaaaatgtttgtagctggctataaacaagatcatgcagattgggttcctgagccaacaaacccaaagaagaccggttgctaggaagagaaagccgagcgttgctccgtgacgtcatcactccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttgtacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaaggaagtaatgacttaaagtttcagatattctttgtgtatttattgtctgttgaggaagaagaaaatatagatgatcattgagcacttgtgaatacaaaaaatacttaaaccaaacttaacttttttcaaaaaagaatgacttaaagttgtatgtcaccatttaatacatatcatagggaaatgggaaaggtggtctttactcataaatacatgaccgagagaagatccacatataaaattccctgccctcttctcctccttcttttgactgttgtctgcagatgcttcaaggaagtctactgaaacaaatggcggttggaatatatatgcaggtttagacatggaggaaggaacagtagctataaaacaagaactaagcttattctaaaattttgccaccaactccaaaggtagactgaagtacaggtagtttgcctgtttgttaaggagtgatatttattttccattcttcacatctcagtagagtgtaaataaaagactgatattttgaaaaggtgaacaaaattggcaaacctttagccaggctcattaagaaatgagagaaagaaagatgacataaatcaacaaatcaggaatgaaaaggagacattattacagacatgaaaaggacaataagaaagattacaaacaactttatgcccattaaattgaagacttagatgaaatagacaaatgctttgaaagaaactaccaaagctcacttatggaatagatatattcctttaatataatttatgactgagtagtcataaattacttttaaaaatataatttgtgttaagaaccaacaaagaaaactctagccccagatgcctttactgtcaaaatctacccaacattgaatgaaggaataataccagttctacacaaactttacca
